United States Patent
Chevessier-Tünnesen et al.

(10) Patent No.: US 11,739,335 B2
(45) Date of Patent: Aug. 29, 2023

(54) NUCLEIC ACIDS ENCODING CRISPR-ASSOCIATED PROTEINS AND USES THEREOF

(71) Applicant: CureVac SE, Tübingen (DE)

(72) Inventors: Frédéric Chevessier-Tünnesen, Tübingen (DE); Marion Poenisch, Tübingen (DE); Thomas Schlake, Tübingen (DE)

(73) Assignee: CureVac SE, Tübingen (DE)

( * ) Notice: Subject to any disclaimer, the term of this patent is extended or adjusted under 35 U.S.C. 154(b) by 160 days.

(21) Appl. No.: 16/496,518

(22) PCT Filed: Mar. 23, 2018

(86) PCT No.: PCT/EP2018/057552
§ 371 (c)(1),
(2) Date: Sep. 23, 2019

(87) PCT Pub. No.: WO2018/172556
PCT Pub. Date: Sep. 27, 2018

(65) Prior Publication Data
US 2021/0403925 A1 Dec. 30, 2021

(30) Foreign Application Priority Data

Mar. 24, 2017 (WO) .................. PCT/EP2017/057110
Oct. 19, 2017 (WO) .................. PCT/EP2017/076775

(51) Int. Cl.
| | |
|---|---|
| C12N 15/11 | (2006.01) |
| C12N 15/67 | (2006.01) |
| A61K 31/7088 | (2006.01) |
| A61K 48/00 | (2006.01) |
| C12N 9/22 | (2006.01) |
| C12N 15/113 | (2010.01) |
| C12N 15/62 | (2006.01) |

(52) U.S. Cl.
CPC .......... *C12N 15/67* (2013.01); *A61K 31/7088* (2013.01); *A61K 48/0066* (2013.01); *C12N 9/22* (2013.01); *C12N 15/113* (2013.01); *C12N 15/62* (2013.01); *C12N 2310/20* (2017.05); *C12N 2310/531* (2013.01)

(58) Field of Classification Search
CPC .................................................. A61K 48/0066
See application file for complete search history.

(56) References Cited

U.S. PATENT DOCUMENTS

| | | | |
|---|---|---|---|
| 2005/0032730 A1 | 2/2005 | von der Mülbe et al. | |
| 2005/0059624 A1 | 3/2005 | Hoerr et al. | |
| 2005/0250723 A1 | 11/2005 | Hoerr et al. | |
| 2006/0188490 A1 | 8/2006 | Hoerr et al. | |
| 2008/0025944 A1 | 1/2008 | Hoerr et al. | |
| 2008/0267873 A1 | 10/2008 | Hoerr et al. | |
| 2009/0324584 A1 | 12/2009 | Hoerr et al. | |
| 2010/0048883 A1 | 2/2010 | Ketterer et al. | |
| 2010/0189729 A1 | 7/2010 | Hoerr et al. | |
| 2010/0203076 A1 | 8/2010 | Fotin-Mleczek et al. | |
| 2010/0291156 A1 | 11/2010 | Barner et al. | |
| 2010/0305196 A1 | 12/2010 | Probst et al. | |
| 2011/0053829 A1 | 3/2011 | Baumhof et al. | |
| 2011/0250225 A1 | 10/2011 | Fotin-Mleczek et al. | |
| 2012/0021043 A1 | 1/2012 | Kramps et al. | |
| 2012/0258046 A1 | 10/2012 | Mutzke | |
| 2013/0129754 A1 | 5/2013 | Thess et al. | |
| 2013/0142818 A1 | 6/2013 | Baumhof et al. | |
| 2013/0259879 A1 | 10/2013 | Baumhof et al. | |
| 2013/0280283 A1 | 10/2013 | Lorenz et al. | |
| 2013/0295043 A1 | 11/2013 | Kallen et al. | |
| 2013/0336998 A1 | 12/2013 | Kallen et al. | |
| 2014/0068797 A1* | 3/2014 | Doudna ............... | C12N 15/102 435/375 |
| 2015/0037326 A1 | 2/2015 | Butler-Ransohoff et al. | |
| 2015/0050302 A1 | 2/2015 | Thess | |
| 2015/0057340 A1 | 2/2015 | Thess et al. | |
| 2015/0093413 A1 | 4/2015 | Thess et al. | |
| 2015/0118183 A1 | 4/2015 | Baumhof | |
| 2015/0118264 A1 | 4/2015 | Baumhof et al. | |
| 2015/0165006 A1 | 6/2015 | Thess et al. | |

(Continued)

FOREIGN PATENT DOCUMENTS

| | | | | |
|---|---|---|---|---|
| WO | WO-2013143700 A2 * | 10/2013 | ............. | A61K 38/00 |
| WO | WO 2014/204724 | 12/2014 | | |
| WO | WO 2015/006747 | 1/2015 | | |
| WO | WO 2016/107877 | 7/2016 | | |
| WO | WO 2016/197132 | 12/2016 | | |
| WO | WO 2017/001058 | 1/2017 | | |
| WO | WO 2017/036580 | 3/2017 | | |
| WO | WO-2017036580 A1 * | 3/2017 | ............. | A61K 35/12 |
| WO | WO 2018/211038 | 11/2018 | | |
| WO | WO 2019/067910 | 4/2019 | | |
| WO | WO 2019/077001 | 4/2019 | | |
| WO | WO 2019/092153 | 5/2019 | | |

(Continued)

OTHER PUBLICATIONS

Thess et al., "Sequence-Engineered mRNA Without Chemical Nucleoside Modifications Enables an Effective Protein Therapy in Large Animals," *Molecular Therapy*, 23(9):1456-1464, 2015.

(Continued)

*Primary Examiner* — Ekaterina Poliakova-Georgantas
(74) *Attorney, Agent, or Firm* — Parker Highlander PLLC

(57) ABSTRACT

The present invention relates to the field of biomedicine, and in particular to the field of therapeutic nucleic acids. The present invention provides artificial nucleic acids, in particular RNAs, encoding CRISPR-associated proteins. A (pharmaceutical) composition and kit-of-parts comprising the same are also provided. Furthermore, the present invention relates to the artificial nucleic acid, (pharmaceutical) composition, or kit-of-parts for use in medicine, and in particular in the treatment and/or prophylaxis of diseases amenable to treatment with CRISPR-associated proteins.

18 Claims, 12 Drawing Sheets

Specification includes a Sequence Listing.

(56) References Cited

U.S. PATENT DOCUMENTS

| | | |
|---|---|---|
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326548 A1 | 11/2016 | Cost |
| 2016/0326575 A1 | 11/2016 | von der Mülbe et al. |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |
| 2019/0194760 A1 | 6/2019 | Koch et al. |
| 2019/0225971 A1 | 7/2019 | Williams |
| 2019/0241633 A1 | 8/2019 | Fotin-Mleczek et al. |
| 2019/0249219 A1 | 8/2019 | Reichert et al. |
| 2019/0336608 A1 | 11/2019 | Baumhof et al. |
| 2019/0336611 A1 | 11/2019 | Baumhof et al. |
| 2019/0343933 A1 | 11/2019 | Horscroft et al. |
| 2019/0343942 A1 | 11/2019 | Fotin-Mleczek et al. |
| 2019/0351044 A1 | 11/2019 | Jasny et al. |
| 2019/0351047 A1 | 11/2019 | Jasny et al. |
| 2019/0351048 A1 | 11/2019 | Rauch |
| 2019/0381180 A1 | 12/2019 | Baumhof et al. |
| 2020/0023076 A1 | 1/2020 | Fotin-Mleczek et al. |
| 2020/0085852 A1 | 3/2020 | Fotin-Mleczek |
| 2020/0085944 A1 | 3/2020 | Heidenreich et al. |
| 2020/0149026 A1 | 5/2020 | Horscroft et al. |
| 2020/0163878 A1 | 5/2020 | Baumhof et al. |
| 2020/0179526 A1 | 6/2020 | Baumhof et al. |
| 2020/0318097 A1 | 10/2020 | Funkner et al. |
| 2020/0392572 A1 | 12/2020 | Yazdan Panah et al. |
| 2021/0030864 A1 | 2/2021 | Petsch et al. |
| 2021/0069315 A1 | 3/2021 | Baumhof et al. |
| 2021/0162037 A1 | 6/2021 | Jasny et al. |
| 2021/0170017 A1 | 6/2021 | Lutz et al. |
| 2021/0180106 A1 | 6/2021 | Wochner et al. |
| 2021/0205434 A1 | 7/2021 | Petsch et al. |

FOREIGN PATENT DOCUMENTS

| | | |
|---|---|---|
| WO | WO 2019/193183 | 10/2019 |
| WO | WO 2020/002525 | 1/2020 |
| WO | WO 2020/002598 | 1/2020 |
| WO | WO 2020/123300 | 6/2020 |
| WO | WO 2020/127959 | 6/2020 |
| WO | WO 2020/128031 | 6/2020 |

OTHER PUBLICATIONS

Friedland et al., Heritable genome editing in C. elegans via a CRISPR-Cas9 system, *Nature Methods*, 10(8):741-743, 2013.

Moreno-Mateos et al., "CRISPRscan: designing highly efficient sgRNAs for CRISPR-Cas9 targeting in vivo," *Nature Methods*, 12(10):982-988, 2015.

PCT International Search Report and Written Opinion issued in International Application No. PCT/EP2018/057552, dated Sep. 4, 2018.

* cited by examiner

NUCLEIC ACIDS ENCODING CRISPR-ASSOCIATED PROTEINS AND USES THEREOF

This application is a national phase application under 35 U.S.C. § 371 of International Application No. PCT/EP2018/057552, filed Mar. 23, 2018, which claims benefit of International Application No. PCT/EP2017/076775, filed Oct. 19, 2017 and International Application No. PCT/EP2017/057110, filed Mar. 24, 2017, the entire contents of each of which are hereby incorporated by reference.

The present invention relates to artificial nucleic acids, in particular RNAs, encoding CRISPR-associated proteins, and (pharmaceutical) compositions and kit-of-parts comprising the same. Said artificial nucleic acids, in particular RNAs, (pharmaceutical) compositions and kits are inter alia envisaged for use in medicine, for instance in gene therapy, and in particular in the treatment and/or prophylaxis of diseases amenable to treatment with CRISPR-associated proteins, e.g. by gene editing, knock-in, knock-out or modulating the expression of target genes of interest.

CRISPR (Clustered Regularly Interspaced Short Palindromic Repeats)-Cas systems confer adaptive immune protection to bacteria and archaea against invading DNA elements (e.g., viruses, plasmids) by using antisense RNAs to recognize and cleave foreign DNA in a sequence-specific manner. In the latest classification, the diverse CRISPR-Cas systems are divided into two classes according to the configuration of their effectors: Class 1 CRISPR systems utilize several Cas (CRISPR-associated) proteins and the CRISPR-RNA (crRNA) as a guide RNA (gRNA) to form an effector complex, whereas Class 2 CRISPR systems employ a large single-component Cas protein in conjunction with crRNAs to mediate interference with foreign DNA elements. Multiple Class 1 CRISPR-Cas systems, which include the type I and type III systems, have been identified and functionally characterized in detail. Most Class 2 CRISPR-Cas systems that have been identified and experimentally characterized to date employ homologous RNA-guided endonucleases of the Cas9 family as effectors, which function as multi-domain endonucleases, along with crRNA and trans-activating crRNA (tracrRNA), or alternatively with a synthetic single-guide RNA (sgRNA), to cleave both strands of the invading target DNA (Sander and Joung, Nat Biotechnol. 2014 April; 32(4): 347-355, Boettcher and McManus Mol Cell. 2015 May 21; 58(4): 575-585).

The native CRISPR/Cas9 type II system essentially functions in three steps. Upon exposure to foreign DNA, a short foreign DNA sequence (protospacer) is incorporated into the bacterial genome between short palindromic repeats in the CRISPR loci. A short stretch of conserved nucleotides proximal to the protospacer (protospacer adjacent motif (PAM)) is used to acquire the protospacer (acquisition or adaptation phase). Subsequently, the host prokaryotic organism transcribes and processes CRISPR loci to generate mature CRISPR RNA (crRNA) containing both CRISPR repeat elements and the integrated spacer genetic segment of the foreign DNA corresponding to the previous non-self DNA element, along with trans-activating CRISPR RNA (tracrRNA) (expression or maturation step). Finally, crRNA and Cas9 associate with the tracrRNA yielding a crRNA:tracrRNA:Cas9 complex which associates with the complementary sequence in the invading DNA. The Cas9 endonuclease then introduces a DNA double strand break (DSB) into the target DNA (interference phase) (Sander and Joung, Nat Biotechnol. 2014 April; 32(4): 347-355).

Mammalian cells respond to DSBs by either non-homologous end joining method (NHEJ) or homology directed repair (HDR). NHEJ can introduce random insertion or deletion of short stretches of nucleotide bases, leading to gene mutations, and loss-of-function effects. In HDR, introduction of a DNA segment with regions having homology to the sequences flanking both sides of the DNA double strand break will lead to the repair by the host cell's machinery (Sander and Joung, Nat Biotechnol. 2014 April; 32(4): 347-355).

A second, putative Class 2 CRISPR system, tentatively assigned to type V, has been recently identified in several bacterial genomes. The putative type V CRISPR-Cas systems contain a large, ~1,300 amino acid protein called Cpf1 or Cas12 (CRISPR from *Prevotella, Francisella* 1, Acidaminococcus sp BV3L6 (AsCpf1) and Lachnospiraceae bacterium ND2006 (LbCpf1)). Cpf1 requires only one short crRNA to recognize and bind to its target DNA sequence, instead of the ~100-nt guide RNA (crRNA and tracrRNA) for Cas9. I.e. Cpf1 usually shows a single 42 nt which has a 23 nt at its 3' end that is complementary to the protospacer of the target DNA sequence, TTTN PAMs 5' of the protospacer and generates as DSB 5' overhangs compared to blunt ends for spCas9. Cpf1 efficiently cleaves target DNA proceeded by a short T-rich protospacer adjacent motif (PAM), in contrast to the G-rich PAM following the target DNA for Cas9 systems. Third, Cpf1 introduces a staggered DNA double stranded break with a 4 or 5-nt 5' overhang (Zetsche et al. Cell. 2015 Oct. 22; 163(3): 759-771). On-target efficiencies of Cpf1 in human cells are comparable to spCas9 and Cpf1 shows no or reduced off-target cleavage.

Since the application of CRISPR/Cas systems in mammalian genomes, the technology has rapidly evolved: Catalytically inactive or "dead" Cas9 (dCas9), which exhibit no endonuclease activity, can be specifically recruited by suitable gRNAs to target DNA sequences of interest. Such Cas proteins and their variants and derivatives are of particular interest as versatile, sequence-specific and non-mutagenic gene regulation tools. E.g., appropriate gRNAs can be used to target dCas9 derivatives with transcription repression or activation domains to target genes, resulting in transcription repression (called CRISPR interference, CRISPRi) or activation (called CRISPR activation, CRISPRa).

With these successive innovations, CRISPR-Cas systems have become widely adapted for genome engineering. CRISPR-Cas systems are versatile and readily customizable, as gRNAs specific for a target gene of interest can be easily prepared, whereas the Cas protein does not require any modification. Multiple loci can be easily targeted by introducing several gRNAs ("multiplexing").

The CRISPR/Cas system has been successfully adopted as a robust, versatile and precise tool for genome editing and transcription activation/repression in bacterial and eukaryotic organisms, and has sparked the development of promising new approaches for research and therapeutic purposes. However, despite its numerous advantages, application of the CRISPR/Cas system is often hampered by poor expression of the Cas protein.

It is an object of the present invention to comply with these needs and to provide improved therapeutic approaches for treatment of cancers, infectious diseases and other diseases and conditions defined herein. The object underlying the present invention is solved by the claimed subject matter.

Although the present invention is described in detail below, it is to be understood that this invention is not limited to the particular methodologies, protocols and reagents described herein as these may vary. It is also to be understood that the terminology used herein is not intended to limit the scope of the present invention which will be limited only by the appended claims. Unless defined otherwise, all technical and scientific terms used herein have the same meanings as commonly understood by one of ordinary skill in the art.

In the following, the elements of the present invention will be described. These elements are listed with specific embodiments, however, it should be understood that they may be combined in any manner and in any number to create additional embodiments. The variously described examples and preferred embodiments should not be construed to limit the present invention to only the explicitly described embodiments. This description should be understood to support and encompass embodiments which combine the explicitly described embodiments with any number of the disclosed and/or preferred elements. Furthermore, any permutations and combinations of all described elements in this application should be considered disclosed by the description of the present application unless the context indicates otherwise.

Throughout this specification and the claims which follow, unless the context requires otherwise, the term "comprise", and variations such as "comprises" and "comprising", will be understood to imply the inclusion of a stated member, integer or step but not the exclusion of any other non-stated member, integer or step. The term "consist of" is a particular embodiment of the term "comprise", wherein any other non-stated member, integer or step is excluded. In the context of the present invention, the term "comprise" encompasses the term "consist of". The term "comprising" thus encompasses "including" as well as "consisting" e.g., a composition "comprising" X may consist exclusively of X or may include something additional e.g., X+Y.

The terms "a" and "an" and "the" and similar reference used in the context of describing the invention (especially in the context of the claims) are to be construed to cover both the singular and the plural, unless otherwise indicated herein or clearly contradicted by context. Recitation of ranges of values herein is merely intended to serve as a shorthand method of referring individually to each separate value falling within the range. Unless otherwise indicated herein, each individual value is incorporated into the specification as if it were individually recited herein. No language in the specification should be construed as indicating any non-claimed element essential to the practice of the invention.

The word "substantially" does not exclude "completely" e.g., a composition which is "substantially free" from Y may be completely free from Y. Where necessary, the word "substantially" may be omitted from the definition of the invention.

The term "about" in relation to a numerical value x means x±10%.

In the present invention, if not otherwise indicated, different features of alternatives and embodiments may be combined with each other.

For the sake of clarity and readability the following definitions are provided. Any technical feature mentioned for these definitions may be read on each and every embodiment of the invention. Additional definitions and explanations may be specifically provided in the context of these embodiments.

Definitions

Artificial nucleic acid molecule: An artificial nucleic acid molecule may typically be understood to be a nucleic acid molecule, e.g. a DNA or an RNA, that does not occur naturally. In other words, an artificial nucleic acid molecule may be understood as a non-natural nucleic acid molecule. Such nucleic acid molecule may be non-natural due to its individual sequence (which does not occur naturally) and/or due to other modifications, e.g. structural modifications of nucleotides, which do not occur naturally. An artificial nucleic acid molecule may be a DNA molecule, an RNA molecule or a hybrid-molecule comprising DNA and RNA portions. Typically, artificial nucleic acid molecules may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term "wild type" may be understood as a sequence occurring in nature. Further, the term "artificial nucleic acid molecule" is not restricted to mean "one single molecule" but is, typically, understood to comprise an ensemble of identical molecules. Accordingly, it may relate to a plurality of identical molecules contained in an aliquot.

DNA: DNA is the usual abbreviation for deoxy-ribo-nucleic acid. It is a nucleic acid molecule, i.e. a polymer consisting of nucleotides. These nucleotides are usually deoxy-adenosine-monophosphate, deoxy-thymidine-monophosphate, deoxy-guanosine-monophosphate and deoxy-cytidine-monophosphate monomers which are—by themselves—composed of a sugar moiety (deoxyribose), a base moiety and a phosphate moiety, and polymerise by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA sequence. DNA may be single stranded or double stranded. In the double stranded form, the nucleotides of the first strand typically hybridize with the nucleotides of the second strand, e.g. by A/T-base-pairing and G/C-base-pairing.

Heterologous sequence: Two sequences are typically understood to be heterologous' if they are not derivable from the same gene. I.e., although heterologous sequences may be derivable from the same organism, they naturally (in nature) do not occur in the same nucleic acid molecule, such as in the same mRNA.

Cloning site: A cloning site is typically understood to be a segment of a nucleic acid molecule, which is suitable for insertion of a nucleic acid sequence, e.g., a nucleic acid sequence comprising an open reading frame. Insertion may be performed by any molecular biological method known to the one skilled in the art, e.g. by restriction and ligation. A cloning site typically comprises one or more restriction enzyme recognition sites (restriction sites). These one or more restrictions sites may be recognized by restriction enzymes which cleave the DNA at these sites. A cloning site which comprises more than one restriction site may also be termed a multiple cloning site (MCS) or a polylinker.

Nucleic acid molecule: A nucleic acid molecule is a molecule comprising, preferably consisting of nucleic acid components. The term nucleic acid molecule preferably refers to DNA or RNA molecules. It is preferably used synonymous with the term "polynucleotide". Preferably, a nucleic acid molecule is a polymer comprising or consisting of nucleotide monomers, which are covalently linked to each other by phosphodiester-bonds of a sugar/phosphate-backbone. The term "nucleic acid molecule" also encompasses modified nucleic acid molecules, such as base-modified, sugar-modified or backbone-modified etc. DNA or RNA molecules.

Open reading frame: An open reading frame (ORF) in the context of the invention may typically be a sequence of several nucleotide triplets, which may be translated into a peptide or protein. An open reading frame preferably contains a start codon, i.e. a combination of three subsequent nucleotides coding usually for the amino acid methionine (ATG), at its 5'-end and a subsequent region, which usually exhibits a length which is a multiple of 3 nucleotides. An ORF is preferably terminated by a stop-codon (e.g., TM, TAG, TGA). Typically, this is the only stop-codon of the open reading frame. Thus, an open reading frame in the context of the present invention is preferably a nucleotide sequence, consisting of a number of nucleotides that may be divided by three, which starts with a start codon (e.g. ATG) and which preferably terminates with a stop codon (e.g., TM, TGA, or TAG). The open reading frame may be isolated or it may be incorporated in a longer nucleic acid sequence, for example in a vector or an mRNA. An open reading frame may also be termed "(protein) coding sequence" or, preferably, "coding sequence".

Peptide: A peptide or polypeptide is typically a polymer of amino acid monomers, linked by peptide bonds. It typically contains less than 50 monomer units. Nevertheless, the term peptide is not a disclaimer for molecules having more than 50 monomer units. Long peptides are also called polypeptides, typically having between 50 and 600 monomeric units.

Protein: A protein typically comprises one or more peptides or polypeptides. A protein is typically folded into 3-dimensional form, which may be required for the protein to exert its biological function.

Restriction site: A restriction site, also termed restriction enzyme recognition site, is a nucleotide sequence recognized by a restriction enzyme. A restriction site is typically a short, preferably palindromic nucleotide sequence, e.g. a sequence comprising 4 to 8 nucleotides. A restriction site is preferably specifically recognized by a restriction enzyme. The restriction enzyme typically cleaves a nucleotide sequence comprising a restriction site at this site. In a double-stranded nucleotide sequence, such as a double-stranded DNA sequence, the restriction enzyme typically cuts both strands of the nucleotide sequence.

RNA, mRNA: RNA is the usual abbreviation for ribonucleic-acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. In vivo, transcription of DNA usually results in the so-called premature RNA which has to be processed into so-called messenger-RNA, usually abbreviated as mRNA. Processing of the premature RNA, e.g. in eukaryotic organisms, comprises a variety of different posttranscriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein. Typically, a mature mRNA comprises a 5'-cap, a 5'-UTR, an open reading frame, a 3'-UTR and a poly(A) sequence. Aside from messenger RNA, several non-coding types of RNA exist which may be involved in regulation of transcription and/or translation.

Sequence of a nucleic acid molecule: The sequence of a nucleic acid molecule is typically understood to be the particular and individual order, i.e. the succession of its nucleotides. The sequence of a protein or peptide is typically understood to be the order, i.e. the succession of its amino acids.

Sequence identity: Two or more sequences are identical if they exhibit the same length and order of nucleotides or amino acids. The percentage of identity typically describes the extent to which two sequences are identical, i.e. it typically describes the percentage of nucleotides that correspond in their sequence position with identical nucleotides of a reference-sequence. For determination of the degree of identity ("% identity), the sequences to be compared are typically considered to exhibit the same length, i.e. the length of the longest sequence of the sequences to be compared. This means that a first sequence consisting of 8 nucleotides is 80% identical to a second sequence consisting of 10 nucleotides comprising the first sequence. In other words, in the context of the present invention, identity of sequences preferably relates to the percentage of nucleotides or amino acids of a sequence which have the same position in two or more sequences having the same length. Specifically, the "% identity" of two amino acid sequences or two nucleic acid sequences may be determined by aligning the sequences for optimal comparison purposes (e.g., gaps can be introduced in either sequences for best alignment with the other sequence) and comparing the amino acids or nucleotides at corresponding positions. Gaps are usually regarded as non-identical positions, irrespective of their actual position in an alignment. The "best alignment" is typically an alignment of two sequences that results in the highest percent identity. The percent identity is determined by the number of identical nucleotides in the sequences being compared (i.e., % identity=# of identical positions/total # of positions×100). The determination of percent identity between two sequences can be accomplished using a mathematical algorithm known to those of skill in the art.

Stabilized nucleic acid molecule: A stabilized nucleic acid molecule is a nucleic acid molecule, preferably a DNA or RNA molecule that is modified such, that it is more stable to disintegration or degradation, e.g., by environmental factors or enzymatic digest, such as by an exo- or endonuclease degradation, than the nucleic acid molecule without the modification. Preferably, a stabilized nucleic acid molecule in the context of the present invention is stabilized in a cell, such as a prokaryotic or eukaryotic cell, preferably in a mammalian cell, such as a human cell. The stabilization effect may also be exerted outside of cells, e.g. in a buffer solution etc., for example, in a manufacturing process for a pharmaceutical composition comprising the stabilized nucleic acid molecule.

Transfection: The term "transfection" refers to the introduction of nucleic acid molecules, such as DNA or RNA (e.g. mRNA) molecules, into cells, preferably into eukaryotic cells. In the context of the present invention, the term "transfection" encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction is non-viral.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising an open reading frame. Such vectors may be storage vectors, expression vectors, cloning vectors, transfer vectors etc. A storage vector is a vector, which allows the convenient storage of a nucleic acid molecule, for example, of an mRNA molecule. Thus, the vector may comprise a sequence corresponding, e.g., to a desired mRNA sequence or a part thereof, such as a sequence corresponding to the coding sequence and the 3'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector, which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication.

Vehicle: A vehicle is typically understood to be a material that is suitable for storing, transporting, and/or administering a compound, such as a pharmaceutically active compound. For example, it may be a physiologically acceptable liquid, which is suitable for storing, transporting, and/or administering a pharmaceutically active compound.

The present invention is in part based on the surprising discovery that particular 3' and/or 5' UTR elements can mediate an increased expression of coding sequences, specifically those encoding CRISPR-associated (Cas) proteins, like Cas9 or Cpf1. The present inventors specifically discovered that certain combinations of 3' and 5' UTR elements are particularly advantageous for providing a desired expression profile and amounts of expressed protein. In particular, high Cas protein expression for a short period of time (around 24 hours, "pulse expression") may be desired for many applications, e.g. in order to minimize exposure of genomic DNA to reduce off-target effects (i.e. any unintended effects on any one or more target, gene, or cellular transcript). The synergistic action of such 3' and 5' UTR elements in a CRISPR-associated protein-encoding artificial nucleic acid is particularly beneficial when transient expression of high amounts of such proteins are desired in vitro or in vivo. Such artificial nucleic acids thus inter alia lend themselves for various therapeutic applications that are amenable to treatment by introducing mutations, gene knock-outs or knock-ins, or modulating the expression of genes of interest.

Accordingly, in a first aspect, the present invention thus relates to an artificial nucleic acid molecule comprising a. at least one coding region encoding at least one CRISPR-associated protein; b. at least one 5' untranslated region (5' UTR) element derived from a 5' UTR of a gene selected from the group consisting of ATP5A1, RPL32, HSD17B4, SLC7A3, NOSIP and NDUFA4; and c. at least one 3' untranslated region (3' UTR) element derived from a 3' UTR of a gene selected from the group consisting of GNAS, CASP1, PSMB3, ALB and RPS9.

The term "UTR" refers to an "untranslated region" flanking the coding sequence of an artificial nucleic acid as defined herein. In this context, an "UTR element" comprises or consists of a nucleic acid sequence, which is derived from the (naturally occurring, wild-type) UTR of a particular gene, preferably as exemplified herein.

When referring to UTR elements "derived from" a particular UTR, reference is made to nucleic acid sequences corresponding to the sequence of said UTR ("parent UTR") or a homolog, variant or fragment of said UTR. The term includes sequences corresponding to the entire (full-length) wild-type sequence of said UTR, or a homolog, variant or fragment thereof, including full-length homologs and variants, as well as fragments of said full-length wild-type sequences, homologs and variants, and variants of said fragments. The term "corresponds to" means that the nucleic acid sequence derived from the "parent UTR" may be an RNA sequence (e.g. equal to the RNA sequence used for defining said parent UTR sequence), or a DNA sequence (both sense and antisense strand and both mature and immature), which corresponds to such RNA sequence.

When referring to an UTR element derived from an UTR of a gene, "or a homolog, fragment or variant thereof", the expression "or a homolog, fragment or variant thereof" may refer to the gene, or the UTR, or both.

The term "homolog" in the context of genes (or nucleic acid sequences derived therefrom or comprised by said gene, like a UTR) refers to a gene (or a nucleic acid sequences derived therefrom or comprised by said gene) related to a second gene (or such nucleic acid sequence) by descent from a common ancestral DNA sequence. The term, "homolog" includes genes separated by the event of speciation ("ortholog") and genes separated by the event of genetic duplication ("paralog").

The term "variant" in the context of nucleic acid sequences of genes refers to nucleic acid sequence variants, i.e. nucleic acid sequences or genes comprising a nucleic acid sequence that differs in at least one nucleic acid from a reference (or "parent") nucleic acid sequence of a reference (or "parent") nucleic acid or gene. Variant nucleic acids or genes may thus preferably comprise, in their nucleic acid sequence, at least one mutation, substitution, insertion or deletion as compared to their respective reference sequence. Preferably, the term "variant" as used herein includes naturally occurring variants, and engineered variants of nucleic acid sequences or genes. Therefore, a "variant" as defined herein can be derived from, isolated from, related to, based on or homologous to the reference nucleic acid sequence. "Variants" may preferably have a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, to a nucleic acid sequence of the respective naturally occurring (wild-type) nucleic acid sequence or gene, or a homolog, fragment or derivative thereof.

The term "fragment" in the context of nucleic acid sequences or genes refers to a continuous subsequence of the full-length reference (or "parent") nucleic acid sequence or gene. In other words, a "fragment" may typically be a shorter portion of a full-length nucleic acid sequence or gene. Accordingly, a fragment, typically, consists of a sequence that is identical to the corresponding stretch within the full-length nucleic acid sequence or gene. The term includes naturally occurring fragments as well as engineered fragments. A preferred fragment of a sequence in the context of the present invention, consists of a continuous stretch of nucleic acids corresponding to a continuous stretch of entities in the nucleic acid or gene the fragment is derived from, which represents at least 20%, preferably at least 30%, more preferably at least 40%, more preferably at least 50%, even more preferably at least 60%, even more preferably at least 70%, and most preferably at least 80% of the total (i.e. full-length) nucleic acid sequence or gene from which the fragment is derived. A sequence identity indicated with respect to such a fragment preferably refers to the entire nucleic acid sequence or gene. Preferably, a "fragment" may comprise a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, to a reference nucleic acid sequence or gene that it is derived from.

UTR elements used in the context of the present invention are preferably functional, i.e. capable of eliciting the same desired biological effect as the naturally-occurring (wild-type) UTRs that they are derived from, i.e. in particular of controlling (i.e. regulating, preferably enhancing) the expression of an operably linked coding sequence. The term "operably linked" as used herein means that "being placed in a functional relationship to a coding sequence". UTR elements defined herein are preferably operably linked, i.e. placed in a functional relationship to, the coding sequence of the artificial nucleic acid of the invention, preferably in a manner that allows them to control (i.e. regulate, preferably enhance) the expression of said coding sequence. The term "expression" as used herein generally includes all step of protein biosynthesis, inter alia transcription, mRNA processing and translation. The UTR elements specified herein, in particular in the described combinations, are particularly envisaged to enhance transcription of coding sequence encoding the CRISPR-associated protein described herein.

The inventive artificial nucleic acid thus advantageously comprises a 5' UTR element and a 3' UTR element, each derived from a gene selected from those indicated herein. Suitable 5' UTR elements are selected from 5'-UTR elements derived from a 5' UTR of a gene selected from the group consisting of ATP5A1, RPL32, HSD17B4, SLC7A3, NOSIP and NDUFA4, preferably as defined herein. Suitable 3' UTR elements are selected from 3' UTR elements derived from a 3' UTR of a gene selected from the group consisting of GNAS, CASP1, PSMB3, ALB and RPS9, preferably as defined herein.

Typically, 5'- or 3'-UTR elements of the inventive artificial nucleic acid molecules are heterologous to the at least one coding sequence.

Preferably, the UTRs (serving as "parent UTRs" to the UTR elements of the inventive artificial nucleic acid) indicated herein encompass the naturally occurring (wild-type) UTRs, as well as homologs, fragments, variants, and corresponding RNA sequences thereof.

In other words, the artificial nucleic acid may preferably comprise a. at least one coding region encoding at least one CRISPR-associated protein; b. at least one 5' untranslated region (5' UTR) element derived from a 5' UTR of a gene selected from the group consisting of ATP5A1, RPL32, HSD17B4, SLC7A3, NOSIP and NDUFA4, or a homolog, fragment, variant, or corresponding RNA sequence of any one of said 5' UTRs; and c. at least one 3' untranslated region (3' UTR) element derived from a 3' UTR of a gene selected from the group consisting of GNAS, CASP1, PSMB3, ALB and RPS9, or a homolog, fragment, variant, or corresponding RNA sequence of any one of said 3' UTRs.

The 5' UTRs and 3' UTRs are preferably operably linked to the coding sequence of the artificial nucleic acid of the invention.

UTRs
5' UTR

The artificial nucleic acid described herein comprises at least one 5'-UTR element derived from a 5' UTR of a gene as indicated herein, or a homolog, variant or fragment thereof.

The term "5'-UTR" refers to a part of a nucleic acid molecule, which is located 5' (i.e. "upstream") of an open reading frame and which is not translated into protein. In the context of the present invention, a 5'-UTR starts with the transcriptional start site and ends one nucleotide before the start codon of the open reading frame. The 5'-UTR may comprise elements for controlling gene expression, also called "regulatory elements". Such regulatory elements may be, for example, ribosomal binding sites. The 5'-UTR may be post-transcriptionally modified, for example by addition of a 5'-Cap. Thus, 5'-UTRs may preferably correspond to the sequence of a nucleic acid, in particular a mature mRNA, which is located between the 5'-Cap and the start codon, and more specifically to a sequence, which extends from a nucleotide located 3' to the 5'-Cap, preferably from the nucleotide located immediately 3' to the 5'-Cap, to a nucleotide located 5' to the start codon of the protein coding sequence (transcriptional start site), preferably to the nucleotide located immediately 5' to the start codon of the protein coding sequence (transcriptional start site). The nucleotide located immediately 3' to the 5'-Cap of a mature mRNA typically corresponds to the transcriptional start site. 5' UTRs typically have a length of less than 500, 400, 300, 250 or less than 200 nucleotides. In some embodiments its length may be in the range of at least 10, 20, 30 or 40, preferably up to 100 or 150, nucleotides.

Preferably, the at least one 5'UTR element comprises or consists of a nucleic acid sequence derived from the 5' UTR of a chordate gene, preferably a vertebrate gene, more preferably a mammalian gene, most preferably a human gene, or from a variant of the 3'UTR of a chordate gene, preferably a vertebrate gene, more preferably a mammalian gene, most preferably a human gene.

UTR names comprising the extension "0.1" or "var" are identical to the UTR without said extension.

TOP-Gene Derived 5' UTR Elements

Some of the 5'UTR elements specified herein may be derived from the 5'UTR of a TOP gene or from a homolog, variant or fragment thereof.

TOP genes are thus typically characterized by the presence of a 5' terminal oligopyrimidine tract (TOP), and further, typically by a growth-associated translational regulation. However, TOP genes with a tissue specific translational regulation are also known. mRNA that contains a 5'TOP is often referred to as TOP mRNA. Accordingly, genes that provide such messenger RNAs are referred to as TOP genes. TOP sequences have, for example, been found in genes and mRNAs encoding peptide elongation factors and ribosomal proteins.

The 5' terminal oligopyrimidine tract ("5'TOP" or "TOP") is typically a stretch of pyrimidine nucleotides located in the 5' terminal region of a nucleic acid molecule, such as the 5' terminal region of certain mRNA molecules or the 5' terminal region of a functional entity, e.g. the transcribed region, of certain genes.

The 5'UTR of a TOP gene corresponds to the sequence of a 5'UTR of a mature mRNA derived from a TOP gene, which preferably extends from the nucleotide located 3' to the 5'-CAP to the nucleotide located 5' to the start codon. The TOP sequence typically starts with a cytidine, which usually corresponds to the transcriptional start site, and is followed by a stretch of usually about 3 to 30 pyrimidine nucleotides. The pyrimidine stretch and thus the 5' TOP ends one nucleotide 5' to the first purine nucleotide located downstream of the TOP.

A 5'UTR of a TOP gene typically does not comprise any start codons, preferably no upstream AUGs (uAUGs) or upstream open reading frames (uORFs). Therein, upstream AUGs and upstream open reading frames are typically understood to be AUGs and open reading frames that occur 5' of the start codon (AUG) of the open reading frame that should be translated. The 5'UTRs of TOP genes are generally rather short. The lengths of 5'UTRs of TOP genes may vary between 20 nucleotides up to 500 nucleotides, and are typically less than about 200 nucleotides, preferably less than about 150 nucleotides, more preferably less than about 100 nucleotides. For example, a TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides.

In the context of the present invention, a "TOP motif" is a nucleic acid sequence which corresponds to a 5'TOP as defined above. Thus, a TOP motif in the context of the present invention is preferably a stretch of pyrimidine nucleotides having a length of 3-30 nucleotides. Preferably, the TOP-motif consists of at least 3, preferably at least 4, more preferably at least 6, more preferably at least 7, and most preferably at least 8 pyrimidine nucleotides, wherein the stretch of pyrimidine nucleotides preferably starts at its 5'end with a cytosine nucleotide. In TOP genes and TOP mRNAs, the "TOP-motif" preferably starts at its 5'end with the transcriptional start site and ends one nucleotide 5' to the first purin residue in said gene or mRNA. A "TOP motif" in the sense of the present invention is preferably located at the 5'end of a sequence, which represents a 5'UTR, or at the 5'end of a sequence, which codes for a 5'UTR. Thus, preferably, a stretch of 3 or more pyrimidine nucleotides is called "TOP motif" in the sense of the present invention if this stretch is located at the 5'end of a respective sequence, such as the artificial nucleic acid molecule, the 5'UTR element of the artificial nucleic acid molecule, or the nucleic acid sequence which is derived from the 5'UTR of a TOP gene as described herein. In other words, a stretch of 3 or more pyrimidine nucleotides, which is not located at the 5'-end of a 5'UTR or a 5'UTR element but anywhere within a 5'UTR or a 5'UTR element, is preferably not referred to as "TOP motif".

In particularly preferred embodiments, the 5'UTR elements derived from 5'UTRs of TOP genes exemplified herein does not comprise a TOP-motif or a 5'TOP, as defined above. Thus, the nucleic acid sequence of the 5'UTR element, which is derived from a 5'UTR of a TOP gene, may terminate at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'UTR element does not comprise any part of the protein coding sequence. Thus, preferably, the only amino acid coding part of the artificial nucleic acid is provided by the coding sequence encoding the CRISPR-associated protein (and optionally further amino acid sequences as described herein).

Specific 5' UTR elements envisaged in accordance with the present invention are described in detail below.

HSD17B4-Derived 5' UTR Elements

Artificial nucleic acids according to the invention may comprise a 5'UTR element which comprises or consists of a nucleic acid sequence, which is derived from a 5'UTR of a gene encoding a 17-beta-hydroxysteroid dehydrogenase 4, or a homolog, variant or fragment thereof, preferably lacking the 5'TOP motif.

Such 5'UTR elements preferably comprise or consist of a nucleic acid sequence which is derived from the 5'UTR of a 17-beta-hydroxysteroid dehydrogenase 4 ("HSD17B4", also referred to as peroxisomal multifunctional enzyme type 2) gene, preferably from a vertebrate 17-beta-hydroxysteroid dehydrogenase 4 (HSD17B4) gene, more preferably from a mammalian 17-beta-hydroxysteroid dehydrogenase 4 (HSD17B4) gene, most preferably from a human 17-beta-hydroxysteroid dehydrogenase 4 (HSD17B4) gene, or a homolog, variant or fragment of any of said 5' UTRs, wherein preferably the 5'UTR element does not comprise the 5'OP of said gene.

Accordingly, artificial nucleic acids according to the invention may comprise a 5'UTR element derived from a HSD17B4 gene, wherein said 5'UTR element comprises or consists of a DNA sequence according to SEQ ID NO: 1 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to a nucleic acid sequence according to SEQ ID NO: 1, or wherein said 5'UTR element comprises or consists of an RNA sequence according to SEQ ID NO: 2, or a or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to a nucleic acid sequence according to SEQ ID NO: 2.

RPL32-Derived 5'-UTR Elements

Artificial nucleic acids according to the invention may comprise a 5'UTR element which comprises or consists of a nucleic acid sequence, which is derived from a 5'UTR of a gene encoding a ribosomal Large protein (RPL), or a homolog, variant or fragment thereof, wherein said 5' UTR element preferably lacks the 5'TOP (terminal oligopyrimidine tract) motif.

Such 5'UTR elements preferably comprise or consist of a nucleic acid sequence which is derived from the 5'UTR of a ribosomal protein Large 32 ("RPL32") gene, preferably from a vertebrate ribosomal protein Large 32 (L32) gene, more preferably from a mammalian ribosomal protein Large 32 (L32) gene, most preferably from a human ribosomal protein Large 32 (L32) gene, or a homolog, variant or fragment of any of said 5' UTRs, wherein the 5'UTR element preferably does not comprise the 5'TOP of said gene. The term "RPL32" also includes variants and fragments thereof, which are herein also referred to as "RPL32var" or "32L4".

Accordingly, artificial nucleic acids according to the invention may comprise a 5'UTR element derived from a RPL32 gene, wherein said 5'UTR element comprises or consists of a DNA sequence according to SEQ ID NO:21 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO:21, or wherein said 5'UTR element comprises or consists of an RNA sequence according to SEQ ID NO:22, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO:22.

NDUFA4-Derived 5'-UTR Elements

Artificial nucleic acids according to the invention may comprise a 5'UTR element which comprises or consists of a nucleic acid sequence, which is derived from a 5'UTR of a gene encoding a Cytochrome c oxidase subunit (NDUFA4), or a homolog, fragment or variant thereof.

Such 5'UTR elements preferably comprise or consist of a nucleic acid sequence which is derived from the 5'UTR of a Cytochrome c oxidase subunit ("NDUFA4" or "Ndufa4.1") gene, preferably from a vertebrate Cytochrome c oxidase subunit (NDUFA4) gene, more preferably from a mammalian Cytochrome c oxidase subunit (NDUFA4) gene, most preferably from a human Cytochrome c oxidase subunit (NDUFA4) gene, or a homolog, variant or fragment thereof.

Accordingly, artificial nucleic acids according to the invention may comprise a 5'UTR element derived from a NDUFA4 gene, wherein said 5'UTR element comprises or consists of a DNA sequence according to SEQ ID NO:9 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO:9, or wherein said 5'UTR element comprises or consists of an RNA sequence according to SEQ ID NO: 10, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO:10.

SLC7A3-Derived 5'-UTR Elements

Artificial nucleic acids according to the invention may comprise a 5'UTR element which comprises or consists of a nucleic acid sequence, which is derived from a 5'UTR of a gene encoding a solute carrier family 7 member 3 (SLC7A3), or a homolog, fragment or variant thereof.

Such 5'UTR elements preferably comprise or consist of a nucleic acid sequence which is derived from the 5'UTR of a solute carrier family 7 member 3 ("SLC7A3" or "Slc7a3.1") gene, preferably from a vertebrate solute carrier family 7 member 3 (SLC7A3) gene, more preferably from a mammalian solute carrier family 7 member 3 (SLC7A3) gene, most preferably from a human solute carrier family 7 member 3 (SLC7A3) gene, or a homolog, variant or fragment thereof.

Accordingly, artificial nucleic acids according to the invention may comprise a 5'UTR element derived from a SLC7A3 gene, wherein said 5'UTR element comprises or consists of a DNA sequence according to SEQ ID NO:15 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO:15, or wherein said 5'UTR element comprises or consists of an RNA sequence according to SEQ ID NO: 16, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO:16.

NOSIP-Derived 5' UTR Elements

Artificial nucleic acids according to the invention may comprise a 5'UTR element which comprises or consists of a nucleic acid sequence derived from a 5'UTR of a gene encoding a Nitric oxide synthase-interacting protein, or a homolog, variant or fragment thereof.

Such 5'UTR elements preferably comprise or consist of a nucleic acid sequence which is derived from the 5'UTR of a Nitric oxide synthase-interacting protein ("NOSIP" or "Nosip.1") gene, preferably from a vertebrate Nitric oxide synthase-interacting protein (NOSIP) gene, more preferably from a mammalian Nitric oxide synthase-interacting protein (NOSIP) gene, most preferably from a human Nitric oxide synthase-interacting protein (NOSIP) gene, or a homolog, variant or fragment thereof.

Accordingly, artificial nucleic acids according to the invention may comprise a 5'UTR element derived from a NOSIP gene, wherein said 5'UTR element comprises or consists of a DNA sequence according to SEQ ID NO: 11 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 11, or wherein said 5'UTR element comprises or consists of an RNA sequence according to SEQ ID NO: 12, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 12.

ATP5A1-Derived 5'-UTR Elements

Artificial nucleic acids according to the invention may comprise a 5'UTR element which comprises or consists of a nucleic acid sequence, which is derived from a 5'UTR of a gene encoding a mitochondrial ATP synthase subunit alpha (ATP5A1), or a homolog, variant or fragment thereof, wherein said 5' UTR element preferably lacks the 5'TOP motif.

Such 5'UTR elements preferably comprise or consist of a nucleic acid sequence which is derived from the 5'UTR which is derived from the 5'UTR of a mitochondrial ATP synthase subunit alpha ("ATP5A1") gene, preferably from a vertebrate mitochondrial ATP synthase subunit alpha (ATP5A1) gene, more preferably from a mammalian mitochondrial ATP synthase subunit alpha (ATP5A1) gene, most preferably from a human mitochondrial ATP synthase subunit alpha (ATP5A1) gene, or a homolog, variant or fragment thereof, wherein the 5'UTR element preferably does not comprise the 5'TOP of said gene.

Accordingly, artificial nucleic acids according to the invention may comprise a 5'UTR element derived from a ATP5A1 gene, wherein said 5'UTR element comprises or consists of a DNA sequence according to SEQ ID NO: 5 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 5, or wherein said 5'UTR element comprises or consists of an RNA sequence according to SEQ ID NO: 6, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 6.

ASAH1 Derived 5'-UTR Elements

Artificial nucleic acids according to the invention may comprise a 5'UTR element which comprises or consists of a nucleic acid sequence, which is derived from a 5'UTR of a gene encoding a mitochondrial ATP synthase subunit alpha (ASAH1), or a homolog, variant or fragment thereof, wherein said 5' UTR element preferably lacks the 5'TOP motif.

Such 5'UTR elements preferably comprise or consist of a nucleic acid sequence which is derived from the 5'UTR which is derived from the 5'UTR of a mitochondrial ATP synthase subunit alpha ("ASAH1") gene, preferably from a vertebrate mitochondrial ATP synthase subunit alpha (ASAH1) gene, more preferably from a mammalian mitochondrial ATP synthase subunit alpha (ASAH1) gene, most preferably from a human mitochondrial ATP synthase subunit alpha (ASAH1) gene, or a homolog, variant or fragment thereof, wherein the 5'UTR element preferably does not comprise the 5'TOP of said gene.

Accordingly, artificial nucleic acids according to the invention may comprise a 5'UTR element derived from a ASAH1 gene, wherein said 5'UTR element comprises or consists of a DNA sequence according to SEQ ID NO: 3 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 3, or wherein said 5'UTR element comprises or consists of an RNA sequence according to SEQ ID NO: 4, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 4.

MP68-Derived 5'-UTR Elements

Artificial nucleic acids according to the invention may comprise a 5'UTR element which comprises or consists of a nucleic acid sequence, which is derived from a 5'UTR of a gene encoding a mitochondrial ATP synthase subunit alpha (MP68), or a homolog, variant or fragment thereof, wherein said 5' UTR element preferably lacks the 5'TOP motif.

Such 5'UTR elements preferably comprise or consist of a nucleic acid sequence which is derived from the 5'UTR which is derived from the 5'UTR of a mitochondrial ATP synthase subunit alpha ("MP68" or "Mp68") gene, preferably from a vertebrate mitochondrial ATP synthase subunit alpha (MP68) gene, more preferably from a mammalian mitochondrial ATP synthase subunit alpha (MP68) gene, most preferably from a human mitochondrial ATP synthase subunit alpha (MP68) gene, or a homolog, variant or fragment thereof, wherein the 5'UTR element preferably does not comprise the 5'TOP of said gene.

Accordingly, artificial nucleic acids according to the invention may comprise a 5'UTR element derived from a Mp68 gene, wherein said 5'UTR element comprises or consists of a DNA sequence according to SEQ ID NO: 7 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 7, or wherein said 5'UTR element comprises or consists of an RNA sequence according to SEQ ID NO: 8, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 8.

RPL31-Derived 5'-UTR Elements

Artificial nucleic acids according to the invention may comprise a 5'UTR element which comprises or consists of a nucleic acid sequence, which is derived from a 5'UTR of a gene encoding a mitochondrial ATP synthase subunit alpha (RPL31), or a homolog, variant or fragment thereof, wherein said 5' UTR element preferably lacks the 5'TOP motif.

Such 5'UTR elements preferably comprise or consist of a nucleic acid sequence which is derived from the 5'UTR which is derived from the 5'UTR of a mitochondrial ATP synthase subunit alpha ("RPL31" or "Rpl31.1") gene, preferably from a vertebrate mitochondrial ATP synthase subunit alpha (RPL31) gene, more preferably from a mammalian mitochondrial ATP synthase subunit alpha (RPL31) gene, most preferably from a human mitochondrial ATP synthase subunit alpha (RPL31) gene, or a homolog, variant or fragment thereof, wherein the 5'UTR element preferably does not comprise the 5'TOP of said gene.

Accordingly, artificial nucleic acids according to the invention may comprise a 5'UTR element derived from a RPL31 gene, wherein said 5'UTR element comprises or consists of a DNA sequence according to SEQ ID NO: 13 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 13, or wherein said 5'UTR element comprises or consists of an RNA sequence according to SEQ ID NO: 14, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 14.

TUBB4B-Derived 5'-UTR Elements

Artificial nucleic acids according to the invention may comprise a 5'UTR element which comprises or consists of a nucleic acid sequence, which is derived from a 5'UTR of a gene encoding a mitochondrial ATP synthase subunit alpha (TUBB4B), or a homolog, variant or fragment thereof, wherein said 5' UTR element preferably lacks the 5'TOP motif.

Such 5'UTR elements preferably comprise or consist of a nucleic acid sequence which is derived from the 5'UTR which is derived from the 5'UTR of a mitochondrial ATP synthase subunit alpha ("TUBB4B" or "TUBB4B.1") gene, preferably from a vertebrate mitochondrial ATP synthase subunit alpha (TUBB4B) gene, more preferably from a mammalian mitochondrial ATP synthase subunit alpha (TUBB4B) gene, most preferably from a human mitochondrial ATP synthase subunit alpha (TUBB4B) gene, or a homolog, variant or fragment thereof, wherein the 5'UTR element preferably does not comprise the 5'TOP of said gene.

Accordingly, artificial nucleic acids according to the invention may comprise a 5'UTR element derived from a TUBB4B gene, wherein said 5'UTR element comprises or consists of a DNA sequence according to SEQ ID NO: 17 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 17, or wherein said 5'UTR element comprises or consists of an RNA sequence according to SEQ ID NO: 18, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 18.

UBQLN2-Derived 5'-UTR Elements

Artificial nucleic acids according to the invention may comprise a 5'UTR element which comprises or consists of a nucleic acid sequence, which is derived from a 5'UTR of a gene encoding a mitochondrial ATP synthase subunit alpha (UBQLN2), or a homolog, variant or fragment thereof, wherein said 5' UTR element preferably lacks the 5'TOP motif.

Such 5'UTR elements preferably comprise or consist of a nucleic acid sequence which is derived from the 5'UTR which is derived from the 5'UTR of a mitochondrial ATP synthase subunit alpha ("UBQLN2" or "Ubqln2.1") gene, preferably from a vertebrate mitochondrial ATP synthase subunit alpha (UBQLN2) gene, more preferably from a mammalian mitochondrial ATP synthase subunit alpha (UBQLN2) gene, most preferably from a human mitochondrial ATP synthase subunit alpha (UBQLN2) gene, or a homolog, variant or fragment thereof, wherein the 5'UTR element preferably does not comprise the 5'TOP of said gene.

Accordingly, artificial nucleic acids according to the invention may comprise a 5'UTR element derived from a UBQLN2gene, wherein said 5'UTR element comprises or consists of a DNA sequence according to SEQ ID NO: 19 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 19, or wherein said 5'UTR element comprises or consists of an RNA sequence according to SEQ ID NO: 20, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 20.

3' UTR

The artificial nucleic acid described herein further comprises at least one 3'-UTR element derived from a 3' UTR of a gene as indicated herein, or a homolog, variant, fragment of said gene. The term "3'-UTR" refers to a part of a nucleic acid molecule, which is located 3' (i.e. "downstream") of an open reading frame and which is not translated into protein. In the context of the present invention, a 3'-UTR corresponds to a sequence which is located between the stop codon of the protein coding sequence, preferably immediately 3' to the stop codon of the protein coding sequence, and the poly(A) sequence of the artificial nucleic acid molecule, preferably RNA.

Preferably, the at least one 3'UTR element comprises or consists of a nucleic acid sequence derived from the 3'UTR of a chordate gene, preferably a vertebrate gene, more preferably a mammalian gene, most preferably a human gene, or from a variant of the 3'UTR of a chordate gene, preferably a vertebrate gene, more preferably a mammalian gene, most preferably a human gene.

GNAS-Derived 3'-UTR Elements

Artificial nucleic acids according to the invention may comprise a 3'UTR element which comprises or consists of a nucleic acid sequence derived from a 3'UTR of a gene encoding a Guanine nucleotide-binding protein G(s) subunit alpha isoforms short (GNAS), or a homolog, variant or fragment thereof.

Such 3'UTR elements preferably comprises or consists of a nucleic acid sequence which is derived from the 3'UTR of a Guanine nucleotide-binding protein G(s) subunit alpha isoforms short ("GNAS" or "Gnas.1") gene, preferably from a vertebrate Guanine nucleotide-binding protein G(s) subunit alpha isoforms short (GNAS) gene, more preferably from a mammalian Guanine nucleotide-binding protein G(s) subunit alpha isoforms short (GNAS) gene, most preferably from a human Guanine nucleotide-binding protein G(s) subunit alpha isoforms short (GNAS) gene, or a homolog, variant or fragment thereof.

Accordingly, artificial nucleic acids according to the invention may comprise a 3' UTR element derived from a GNAS gene, wherein said 3'UTR element comprises or consists of a DNA sequence according to SEQ ID NO: 29 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 29, or wherein said 3'UTR element comprises or consists of an RNA sequence according to SEQ ID NO: 30, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 30.

CASP1-Derived 3'-UTR Elements

Artificial nucleic acids according to the invention may comprise a 3'UTR element which comprises or consists of a nucleic acid sequence derived from a 3'UTR of a gene encoding a Caspase-1 (CASP1), or a homolog, variant or fragment thereof.

Such 3'UTR elements preferably comprises or consists of a nucleic acid sequence which is derived from the 3'UTR of a Caspase-1 ("CASP1" or "CASP1.1") gene, preferably from a vertebrate Caspase-1 (CASP1) gene, more preferably from a mammalian Caspase-1 (CASP1) gene, most preferably from a human Caspase-1 (CASP1) gene, or a homolog, variant or fragment thereof.

Accordingly, artificial nucleic acids according to the invention may comprise a 3'UTR element derived from a CASP1 gene, wherein said 3'UTR element comprises or consists of a DNA sequence according to SEQ ID NO: 25 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 25, or wherein said 3'UTR element comprises or consists of an RNA sequence according to SEQ ID NO: 26, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 26.

PSMB3-Derived 3'-UTR Elements

Artificial nucleic acids according to the invention may comprise a 3'UTR element which comprises or consists of a nucleic acid sequence derived from a 3'UTR of a gene encoding a Proteasome subunit beta type-3 (PSMB3), or a homolog, variant or fragment thereof.

Such 3'UTR elements preferably comprises or consists of a nucleic acid sequence which is derived from the 3'UTR of a Proteasome subunit beta type-3 ("PSMB3" or "PSMB3.1") gene, preferably from a vertebrate Proteasome subunit beta type-3 (PSMB3) gene, more preferably from a mammalian Proteasome subunit beta type-3 (PSMB3) gene, most preferably from a human Proteasome subunit beta type-3 (PSMB3) gene, or a homolog, variant or fragment thereof.

Accordingly, artificial nucleic acids according to the invention may comprise a 3'UTR element derived from a PSMB3 gene, wherein said 3'UTR element comprises or consists of a DNA sequence according to SEQ ID NO: 23 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 23, or wherein said 3'UTR element comprises or consists of an RNA sequence according to SEQ ID NO: 24, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 24.

ALB-Derived 3'UTR Elements

Artificial nucleic acids according to the invention may comprise a 3'UTR element which comprises or consists of a nucleic acid sequence, which is derived from a 3'UTR of a gene encoding Serum albumin (ALB), or a homolog, variant or fragment thereof.

Such 3'UTR elements preferably comprises or consists of a nucleic acid sequence which is derived from the 3'UTR of a Serum albumin ("ALB" or "Albumin7") gene, preferably from a vertebrate Serum albumin (ALB) gene, more preferably from a mammal ran Serum albumin (ALB) gene, most preferably from a human Serum albumin (ALB) gene, or a homolog, variant or fragment thereof.

Accordingly, artificial nucleic acids according to the invention may comprise a 3'UTR element derived from a ALB gene, wherein said 3'UTR element comprises or consists of a DNA sequence according to SEQ ID NO: 35, or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 35, or wherein said 3'UTR element comprises or consists of an RNA sequence according to SEQ ID NO: 36, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 36.

RPS9-Derived 3'-UTR Elements

Artificial nucleic acids according to the invention may comprise a 3'UTR element which comprises or consists of a nucleic acid sequence, which is derived from a 3'UTR of a gene encoding 40S ribosomal protein S9 (RPS9), or a homolog, variant or fragment thereof.

Such 3'UTR elements preferably comprises or consists of a nucleic acid sequence which is derived from the 3'UTR of a 40S ribosomal protein S9 ("RPS9" or "RPS9.1") gene, preferably from a vertebrate 40S ribosomal protein S9 (RPS9) gene, more preferably from a mammalian 40S ribosomal protein S9 (RPS9) gene, most preferably from a human 40S ribosomal protein S9 (RPS9) gene, or a homolog, variant or fragment thereof.

Accordingly, artificial nucleic acids according to the invention may comprise a 3'UTR element derived from a RPS9 gene, wherein said 3'UTR element comprises or consists of a DNA sequence according to SEQ ID NO: 33 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 33, or wherein said 5'UTR element comprises or consists of an RNA sequence according to SEQ ID NO: 34, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 34.

COX6B1-Derived 3'-UTR Elements

Artificial nucleic acids according to the invention may comprise a 3'UTR element which comprises or consists of a nucleic acid sequence, which is derived from a 3'UTR of a COX6B1 gene, or a homolog, variant or fragment thereof.

Such 3'UTR elements preferably comprises or consists of a nucleic acid sequence which is derived from the 3'UTR of COX6B1 (or "COX6B1.1") gene, preferably from a vertebrate COX6B1 gene, more preferably from a mammalian COX6B1 gene, most preferably from a human COX6B1 gene, or a homolog, variant or fragment thereof.

Accordingly, artificial nucleic acids according to the invention may comprise a 3'UTR element derived from a COX6B1 gene, wherein said 3'UTR element comprises or consists of a DNA sequence according to SEQ ID NO: 27 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 27, or wherein said 5'UTR element comprises or consists of an RNA sequence according to SEQ ID NO: 28, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 28.

NDUFA1-Derived 3'-UTR Elements

Artificial nucleic acids according to the invention may comprise a 3'UTR element which comprises or consists of a nucleic acid sequence, which is derived from a 3'UTR of a NDUFA1 gene, or a homolog, variant or fragment thereof.

Such 3'UTR elements preferably comprises or consists of a nucleic acid sequence which is derived from the 3'UTR of NDUFA1 (or "Ndufa1.1") gene, preferably from a vertebrate NDUFA1 gene, more preferably from a mammalian NDUFA1 gene, most preferably from a human NDUFA1 gene, or a homolog, variant or fragment thereof.

Accordingly, artificial nucleic acids according to the invention may comprise a 3'UTR element derived from a NDUFA1 gene, wherein said 3'UTR element comprises or consists of a DNA sequence according to SEQ ID NO: 31 or a homolog, variant or fragment thereof, in particular a DNA sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 31, or wherein said 5'UTR element comprises or consists of an RNA sequence according to SEQ ID NO: 32, or a homolog, variant or fragment thereof, in particular an RNA sequence having, in increasing order of preference, at least at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the nucleic acid sequence according to SEQ ID NO: 32.

UTR Combinations

Preferably, the at least one 5'UTR element and the at least one 3'UTR element act synergistically to increase the expression of the at least one coding sequence operably linked to said UTRs. It is envisaged herein to utilize the recited 5'-UTRs and 3'-UTRs in any useful combination. Particularly useful 5' and 3' UTRs are listed in table 1A below. Particularly useful combinations of 5' UTRs and 3'-UTRs are listed in table 1B below. Particularly preferred embodiments of the invention comprise the combination of the CDS of choice, i.e. Cas9, Cpf1, CasX, CasY, or Cas13 with an UTR-combination selected from the group of HSD17B4/Gnas.1; Slc7a3.1/Gnas.1; ATP5A1/CASP.1; Ndufa4.1/PSMB3.1; HSD17B4/PSMB3.1; RPL32var/albumin7; 32L4/albumin7; HSD17B4/CASP1.1; Slc7a3.1/CASP1.1; Slc7a3.1/PSMB3.1; Nosip.1/PSMB3.1; Ndufa4.1/RPS9.1; HSD17B4/RPS9.1; ATP5A1/Gnas.1; Ndufa4.1/COX6B1.1; Ndufa4.1/Gnas.1; Ndufa4.1/Ndufa1.1; Nosip.1/Ndufa1.1; Rpl31.1/Gnas.1; TUBB4B.1/RPS9.1; and Ubqln2.1/RPS9.1.

TABLE 1A

| Description | Sequence Type | SEQ ID NO |
| --- | --- | --- |
| HSD17B4 5'-UTR | DNA | SEQ ID NO: 1 |
| HSD17B4 5'-UTR | RNA | SEQ ID NO: 2 |
| ASAH1 5'-UTR | DNA | SEQ ID NO: 3 |
| ASAH1 5'-UTR | RNA | SEQ ID NO: 4 |
| ATP5A1 5'-UTR | DNA | SEQ ID NO: 5 |
| ATP5A1 5'-UTR | RNA | SEQ ID NO: 6 |
| Mp68 5'-UTR | DNA | SEQ ID NO: 7 |
| Mp68 5'-UTR | RNA | SEQ ID NO: 8 |
| Ndufa4 5'-UTR | DNA | SEQ ID NO: 9 |
| Ndufa4 5'-UTR | RNA | SEQ ID NO: 10 |
| Nosip 5'-UTR | DNA | SEQ ID NO: 11 |
| Nosip 5'-UTR | RNA | SEQ ID NO: 12 |
| Rpl31 5'-UTR | DNA | SEQ ID NO: 13 |
| Rpl31 5'-UTR | RNA | SEQ ID NO: 14 |
| Slc7a3 5'-UTR | DNA | SEQ ID NO: 15 |
| Slc7a3 5'-UTR | RNA | SEQ ID NO: 16 |
| TUBB4B 5'-UTR | DNA | SEQ ID NO: 17 |
| TUBB4B 5'-UTR | RNA | SEQ ID NO: 18 |
| Ubqln2 5'-UTR | DNA | SEQ ID NO: 19 |
| Ubqln2 5'-UTR | RNA | SEQ ID NO: 20 |
| RPL32 (32L4) 5'-UTR | DNA | SEQ ID NO: 21 |
| RPL32 (32L4) 5'-UTR | RNA | SEQ ID NO: 22 |
| PSMB3 3'-UTR | DNA | SEQ ID NO: 23 |
| PSMB3 3'-UTR | RNA | SEQ ID NO: 24 |
| CASP1 3'-UTR | DNA | SEQ ID NO: 25 |
| CASP1 3'-UTR | RNA | SEQ ID NO: 26 |
| COX6B1 3'-UTR | DNA | SEQ ID NO: 27 |
| COX6B1 3'-UTR | RNA | SEQ ID NO: 28 |
| Gnas 3'-UTR | DNA | SEQ ID NO: 29 |
| Gnas 3'-UTR | RNA | SEQ ID NO: 30 |
| Ndufa1 3'-UTR | DNA | SEQ ID NO: 31 |
| Ndufa1 3'-UTR | RNA | SEQ ID NO: 32 |
| RPS9 3'-UTR | DNA | SEQ ID NO: 33 |
| RPS9 3'-UTR | RNA | SEQ ID NO: 34 |
| ALB7 3'-UTR | DNA | SEQ ID NO: 35 |
| ALB7 3'-UTR | RNA | SEQ ID NO: 36 |

TABLE 1B useful UTR-combinations and corresponding constructs

| UTR combination | SEQ ID NOs |
| --- | --- |
| HSD17B4/Gnas | 413; 2330-2345; 3490-3505; 4650-4665; 5810-5825; 6970-6985; 8130-8145; 9290-9305; 10402-10408; 10554; 10599-10612 |
| Slc7a3/Gnas | 414; 2346-2361; 3506-3521; 4666-4681; 5826-5841; 6986-7001; 8146-8161; 9306-9321; 10409-10415; 10555; 10613-10626 |
| ATP5A1/CASP | 415; 2362-2377; 3522-3537; 4682-4697; 5842-5857; 7002-7017; 8162-8177; 9322-9337; 10416-10422; 10556; 10627-10640 |
| Ndufa4/PSMB3 | 416; 2378-2393; 3538-3553; 4698-4713; 5858-5873; 7018-7033; 8178-8193; 9338-9353; 10423-10429; 10557; 10641-10654 |
| HSD17B4/PSMB3 | 417; 2394-2409; 3554-3569; 4714-4729; 5874-5889; 7034-7049; 8194-8209; 9354-9369; 10430-10436; 10558; 10655-10668 |
| RPL32/albumin7 | 418; 2410-2425; 3570-3585; 4730-4745; 5890-5905; 7050-7065; 8210-8225; 9370-9385; 10437-10443; 10559; 10669-10682 |
| 32L4/albumin7 (Gen5, HSL, PolyC) | 419; 2426-2441; 3586-3601; 4746-4761; 5906-5921; 7066-7081; 8226-8241; 9386-9401; 10444-10450; 10560; 10683-10696 |
| HSD17B4/CASP1 | 420; 2442-2457; 3602-3617; 4762-4777; 5922-5937; 7082-7097; 8242-8257; 9402-9417; 10451-10457; 10561; 10697-10710 |
| Slc7a3/CASP1 | 421; 2458-2473; 3618-3633; 4778-4793; 5938-5953; 7098-7113; 8258-8273; 9418-9433; 10458-10464; 10562; 10711-10724 |
| Slc7a3/PSMB3 | 422; 2474-2489; 3634-3649; 4794-4809; 5954-5969; 7114-7129; 8274-8289; 9434-9449; 10465-10471; 10563; 10725-10738 |
| Nosip/PSMB3 | 423; 2490-2505; 3650-3665; 4810-4825; 5970-5985; 7130-7145; 8290-8305; 9459-9450; 10472-10478; 10564; 10739-10752 |
| Ndufa4/RPS9 | 424; 2506-2521; 3666-3681; 4826-4841; 5986-6001; 7146-7161; 8306-8321; 9466-9481; 10479-10485; 10565; 10753-10766 |
| HSD17B4/RPS9 | 425; 2522-2537; 3682-3697; 4842-4857; 6002-6017; 7162-7177; 8322-8337; 9482-9497; 10486-10492; 10566; 10767-10780 |
| ATP5A1/Gnas | 9498- 9609; 10493-10499; 10567; 10781-10794 |
| Ndufa4/COX6B1 | 9610-9721; 10500-10506; 10568; 10795-10808 |
| Ndufa4/Gnas | 9722-9833; 10507-10513; 10569; 10809-10822 |

TABLE 1B-continued useful UTR-combinations and corresponding constructs

| UTR combination | SEQ ID NOs |
| --- | --- |
| Ndufa4/Ndufa1 | 9834-9945; 10514-10520; 10570; 10823-10836 |
| Nosip/Ndufa1 | 9946-10057; 10521-10527; 10571; 10837-10850 |
| Rpl31/Gnas | 10058-10169; 10528-10534; 10572; 10851-10864 |
| TUBB4B/RPS9 | 10170-10281; 10535-10541; 10573; 10865-10878 |
| Ubqln2/RPS9 | 10282-10393; 10542-10548; 10574; 10879-10892 |
| Mp68/Gnas1 | 14526; 14533; 14540 |
| Mp68/Ndufa1 | 14527; 14534; 14541 |

In some embodiments, the artificial nucleic acid encoding a CRISPR-associated protein from the invention comprises at least one UTR combination selected from the group consisting of HSD17B4/Gnas.1; Slc7a3.1/Gnas.1; ATP5A1/CASP.1; Ndufa4.1/PSMB3.1; HSD17B4/PSMB3.1; RPL32var/albumin7; 32L4/albumin7; HSD17B4/CASP1.1; Slc7a3.1/CASP1.1; Slc7a3.1/PSMB3.1; Nosip.1/PSMB3.1; Ndufa4.1/RPS9.1; HSD17B4/RPS9.1; ATP5A1/Gnas.1; Ndufa4.1/COX6B1.1; Ndufa4.1/Gnas.1; Ndufa4.1/Ndufa1.1; Nosip.1/Ndufa1.1; Rpl31.1/Gnas.1; TUBB4B.1/RPS9.1; Ubqln2.1/RPS9.1; MP68/Gnas1.1 and MP68/Ndufa1.1.

In some embodiments, the artificial nucleic acids according to the invention comprise at least one UTR combination selected from the UTR combinations disclosed in PCT/EP2017/076775 in connection with artificial nucleic acids encoding CRISPR-associated proteins, which is incorporated by reference herein in its entirety. Accordingly, in some embodiments, artificial nucleic acids according to the invention may comprise at least one UTR combination selected from the group consisting of SLC7A3/GNAS; ATP5A1/CASP1; HSD17B4/GNAS; NDUFA4/COX6B1; NOSIP/NDUFA1, NDUFA4/NDUFA1; ATP5A1/GNAS; MP68/NDUFA1; NDUFA4/RPS9; NDUFA4/GNAS; NDUFA4/PSMB3; TUBB4B/RPS9.1; UQBLN2/RPS9; RPL31/GNAS) or HSD17B4/PSMB3.

In some embodiments, artificial nucleic acids according to the invention may thus comprise or consist of a nucleic acid sequence as disclosed in PCT/EP2017/076775 in connection with artificial nucleic acids encoding CRISPR-associated proteins.

Each of the UTR elements defined in table 1 by reference to a specific SEQ ID NO may include variants or fragments thereof, exhibiting at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to the respective nucleic acid sequence defined by reference to its specific SEQ ID NO. The last column of Table 1 clearly disclosed all possible Cas9 and Cpf1 cds which can be combined with the specific advantageous UTR combinations shown in column "5' UTR" incl. SEQ ID NO: and column "3' UTR" incl. SEQ ID NO, i.e. the combinations as disclosed are preferred embodiments of the invention for a skilled artisan. A specifically preferred embodiment resembles a Cas9 or Cpf1 sequence of the invention with 5'UTR SLC7A3 (SEQ ID NO: 15/16) or a derived sequence therefrom and with 3'UTR GNAS (SEQ ID NO: 29/30) or a derived sequence therefrom.

For ease of reference, Table A1 describes particularly preferred and advantageous CDS and UTR combinations.

Each of the sequences identified in table 1 by reference to their specific SEQ ID NO may also be defined by its corresponding DNA sequence, as indicated herein.

Each of the sequences identified in table 1 by reference to their specific SEQ ID NO may be modified (optionally independently from each other) as described below.

Preferred artificial nucleic acids according to the invention may comprise a. at least one 5' UTR element derived from a 5'UTR of a HSD17B4 gene, or from a homolog, a fragment or a variant thereof and at least one 3' UTR element derived from a 3'UTR of a GNAS gene, or from a homolog, a fragment or a variant thereof; or b. at least one 5' UTR element derived from a 5'UTR of a SLC7A3 gene, or from a homolog, a fragment or a variant thereof and at least one 3' UTR element derived from a 3'UTR of a GNAS gene, or from a homolog, a fragment or a variant thereof; or c. at least one 5' UTR element derived from a 5'UTR of a ATP5A1 gene, or from a homolog, a fragment or a variant thereof and at least one 3' UTR element derived from a 3'UTR of a CASP1 gene, or from a homolog, a fragment or a variant thereof; or d. at least one 5' UTR element derived from a 5'UTR of a NDUFA4 gene, or from a homolog, a fragment or a variant thereof and at least one 3' UTR element derived from a 3'UTR of a PSMB3 gene, or from a homolog, a fragment or a variant thereof; or e. at least one 5' UTR element derived from a 5'UTR of a HSD17B4 gene, or from a homolog, a fragment or a variant thereof and at least one 3' UTR element derived from a 3'UTR of a PSSLC7A3MB3 gene, or from a homolog, a fragment or a variant thereof; or f. at least one 5' UTR element derived from a 5'UTR of a RPL32 gene, or from a homolog, a fragment or a variant thereof and at least one 3' UTR element derived from a 3'UTR of a ALB gene, or from a homolog, a fragment or a variant thereof; or g. at least one 5' UTR element derived from a 5'UTR of a HSD17B4 gene, or from a homolog, a fragment or a variant thereof and at least one 3' UTR element derived from a 3'UTR of a CASP1 gene, or from a homolog, a fragment or a variant thereof; or h. at least one 5' UTR element derived from a 5'UTR of a SLC7A3 gene, or from a homolog, a fragment or a variant thereof and at least one 3' UTR element derived from a 3'UTR of a CASP1 gene, or from a homolog, a fragment or a variant thereof; or i. at least one 5' UTR element derived from a 5'UTR of a SLC7A3 gene, or from a homolog, a fragment or a variant thereof and at least one 3' UTR element derived from a 3'UTR of a PSMB3 gene, or from a homolog, a fragment or a variant thereof; or j. at least one 5' UTR element derived from a 5'UTR of a NOSIP gene, or from a homolog, a fragment or a variant thereof and at least one 3' UTR element derived from a 3'UTR of a PSMB3 gene, or from a homolog, a fragment or a variant thereof; or k. at least one 5' UTR element derived from a 5'UTR of a NDUFA4 gene, or from a homolog, a fragment or a variant thereof and at least one 3' UTR element derived from a 3'UTR of a RPS9 gene, or from a homolog, a fragment or a variant thereof; or l. at least one 5' UTR element derived from a 5'UTR of a HSD17B4 gene, or from a homolog, a fragment or a variant thereof and at least one 3' UTR element derived from a 3'UTR of a RPS9 gene, or from a homolog, a fragment or a variant thereof; or m. at least one 5' UTR element derived from a 5'UTR of a ATP5A1 gene, or from a homolog, a fragment or a variant thereof and at least one 3' UTR element derived from a 3'UTR of a GNAS gene, or from a homolog, a fragment or a variant thereof; or n. at least one 5' UTR element derived from a 5'UTR of a NDUFA4 gene, or from a homolog, a fragment or a variant thereof and at least one 3' UTR element derived from a 3'UTR of a COX6B1 gene, or from a homolog, a fragment or a variant thereof; or n. at least one 5' UTR element derived from a 5'UTR of a NDUFA4 gene, or from a homolog, a fragment or a variant thereof and at least one 3' UTR element derived from a 3'UTR of a GNAS gene, or from a homolog, a fragment or a variant thereof; or o. at least one 5' UTR element derived from a 5'UTR of a NDUFA4 gene, or from a homolog, a fragment or a variant thereof and at least one 3' UTR element derived from a 3'UTR of a NDUFA1 gene, or from a homolog, a fragment or a variant thereof; or p. at least one 5' UTR element derived from a 5'UTR of a NOSIP gene, or from a homolog, a fragment or a variant thereof and at least one 3' UTR element derived from a 3'UTR of a NDUFA1 gene, or from a homolog, a fragment or a variant thereof; or q. at least one 5' UTR element derived from a 5'UTR of a RPL31 gene, or from a homolog, a fragment or a variant thereof and at least one 3' UTR element derived from a 3'UTR of a GNAS gene, or from a homolog, a fragment or a variant thereof; or r. at least one 5' UTR element derived from a 5'UTR of a TUBB4B gene, or from a homolog, a fragment or a variant thereof and at least one 3' UTR element derived from a 3'UTR of a RPS9 gene, or from a homolog, a fragment or a variant thereof; or s. at least one 5' UTR element derived from a 5'UTR of a UBQLN2 gene, or from a homolog, a fragment or a variant thereof and at least one 3' UTR element derived from a 3'UTR of a RPS9 gene, or from a homolog, a fragment or a variant thereof;

t. at least one 5' UTR element derived from a 5'UTR of a MP68 gene, or from a homolog, a fragment or a variant thereof and at least one 3' UTR element derived from a 3'UTR of a GNAS gene, or from a homolog, a fragment or a variant thereof; or u. at least one 5' UTR element derived from a 5'UTR of a MP68 gene, or from a homolog, a fragment or a variant thereof and at least one 3' UTR element derived from a 3'UTR of a NDUFA1 gene, or from a homolog, a fragment or a variant thereof.

Particularly preferred artificial nucleic acids may comprise a combination of UTRs according to d, e, g or l.

In some embodiments, artificial nucleic acids according to the invention may not comprise a 3' UTR element derived from a 3'UTR of a ALB gene, or from a homolog, a fragment or a variant thereof.

Coding Sequence

CRISPR-Associated Proteins

The artificial nucleic acid according to the invention comprises at least one coding sequence encoding a CRISPR-associated protein.

The term "CRISPR-associated protein" refers to RNA-guided endonucleases that are part of a CRISPR (Clustered Regularly Interspaced Short Palindromic Repeats) system (and their homologs, variants, fragments or derivatives), which is used by prokaryotes to confer adaptive immunity against foreign DNA elements. CRISPR-associated proteins include, without limitation, Cas9, Cpf1 (Cas12), C2c1, C2c3, C2c2, Cas13, CasX and CasY. As used herein, the term "CRISPR-associated protein" includes wild-type proteins as well as homologs, variants, fragments and derivatives thereof. Therefore, when referring to artificial nucleic acid molecules encoding Cas9, Cpf1 (Cas12), C2c1, C2c3, and C2c2, Cas13, CasX and CasY, said artificial nucleic acid molecules may encode the respective wild-type proteins, or homologs, variants, fragments and derivatives thereof.

CRISPR-associated proteins may be encoded by any gene, or a homolog, variant or fragment thereof. When referring to genes, the term "homolog" or "homologous gene" includes "orthologous genes" and "paralogous genes".

CRISPR-associated proteins (and their homologs, variants, fragments or derivatives) are preferably functional, i.e. exhibit desired biological properties, and/or exert desired biological functions. Said biological properties or biological functions may be comparable or even enhanced as compared to the corresponding reference (or "parent") protein. Functional CRISPR-associated proteins, and homologs, variants, fragments or derivatives thereof preferably retain the ability to be targeted by a guide RNA to DNA sequences of interest in a sequence-specific manner. However, the endonuclease activity (i.e. ability to introduce DSBs into the DNA sequence of interest) typically exerted by wild-type CRISPR-associated proteins may, but is not necessarily retained in all "functional" homologs, variants, fragments and derivatives of CRISPR-associated proteins as described herein.

Specifically, functional homologs, variants, fragments or derivatives are preferably capable of (1) specifically interacting with a target DNA sequence, (2) associating with a suitable guide RNA and optionally (3) recognizing a proto-spacer adjacent motif (PAM) that is juxtaposed to the target DNA sequence. In this context, "interacting with" preferably means binding to, and optionally (further) cleaving (by endonuclease or nickase activity), activating or repressing expression, and/or recruiting effectors. "Specifically" means that the CRISPR-associated protein interacts with the target DNA sequence more readily than it interacts with other, non-target DNA sequences.

When referring to a particular CRISPR-associated protein (such as Cas9, Cpf1) herein, the respective protein is to be understood to encompass all post-translationally modified forms thereof. Post-translational modifications (PTMs) may result in covalent or non-covalent modifications of a given protein. Common post-translational modifications include glycosylation, phosphorylation, ubiquitinylation, S-nitrosylation, methylation, N-acetylation, lipidation, disulfide bond formation, sulfation, acylation, deamination etc. Different PTMs may result, e.g., in different chemistries, activities, localizations, interactions or conformations. However, all post-translationally modified CRISPR-associated proteins envisaged within the context of the present invention preferably remain functional, as defined above.

Homologs

Each CRISPR-associated protein exemplified herein (such as Cas9, Cpf1) preferably also encompasses homologs thereof. When referring to proteins, the term "homolog" encompasses "orthologs" (or "orthologous proteins") and paralogs (or "paralogous proteins"). In this context, "orthologs" are proteins encoded by genes in different species that evolved from a common ancestral gene by speciation. Orthologs often retain the same function(s) in the course of evolution. Thus, functions may be lost or gained when comparing a pair of orthologs. However, in the context of the present invention, orthologous CRISPR-associated proteins preferably retain their ability to associate with a suitable guide RNA to specifically interact with a DNA sequence of interest (i.e., are "functional"). "Paralogs" are genes produced via gene duplication within a genome. Paralogs typically evolve new functions or may eventually become pseudogenes. In the context of the present invention, paralogous CRISPR-associated proteins are preferably functional, as defined above.

Variants

Each CRISPR-associated protein exemplified herein (such as Cas9, Cpf1) preferably also encompasses variants thereof.

The term "variant" as used herein with reference to proteins preferably refers to "sequence variants", i.e. proteins comprising an amino acid sequence that differs in at least one amino acid residue from a reference (or "parent") amino acid sequence of a reference (or "parent") protein.

Variant proteins may thus preferably comprise, in their amino acid sequence, at least one amino acid mutation, substitution, insertion or deletion as compared to their respective reference sequence. Substitutions may be selected from conservative or non-conservative substitutions. In some embodiments, it is preferred that a protein "variant" encoded by the at least one coding sequence of the inventive artificial nucleic acid comprises at least one conservative amino acid substitution, wherein amino acids, originating from the same class, are exchanged for one another. In particular, these are amino acids having aliphatic side chains, positively or negatively charged side chains, aromatic groups in the side chains or amino acids, the side chains of which can form hydrogen bridges, e.g. side chains which have a hydroxyl function. By conservative constitution, e.g. an amino acid having a polar side chain may be replaced by another amino acid having a corresponding polar side chain, or, for example, an amino acid characterized by a hydrophobic side chain may be substituted by another amino acid having a corresponding hydrophobic side chain (e.g. serine (threonine) by threonine (serine) or leucine (isoleucine) by isoleucine (leucine)).

Preferably, the term "variant" as used herein includes naturally occurring variants, e.g. preproproteins, proproteins, and CRISPR-associated proteins that have been subjected to post-translational proteolytic processing (this may involve removal of the N-terminal methionine, signal peptide, and/or the conversion of an inactive or non-functional protein to an active or functional one), and naturally occurring mutant proteins. The term "variant" further encompasses engineered variants of CRISPR-associated proteins, which may be (sequence-)modified to introduce or abolish a certain biological property and/or functionality. Engineered Cas9 variants are discussed in detail below. The terms "transcript variants" or "splice variants" in the context of proteins refer to variants produced from messenger RNAs that are initially transcribed from the same gene, but are subsequently subjected to alternative (or differential) splicing, where particular exons of a gene may be included within or excluded from the final, processed messenger RNA (mRNA). "Transcript variants" of CRISPR-associated proteins, however, preferably retain their desired biological functionality, as defined above. It will be noted that the term "variant" may essentially be defined by way of a minimum degree of sequence identity (and preferably also a desired biological function/properties) as compared to a reference protein. Thus, homologs, fragments or certain derivatives (which also differ in terms of their amino acid sequence from the reference protein) may be classified as "variants" as well. Therefore, a "variant" as defined herein can be derived from, isolated from, related to, based on or homologous to the reference protein, which may be a CRISPR-associated protein (such as Cas9, Cpf1) as defined herein, or a homolog, fragment variant or derivative thereof.

CRISPR-associated protein (such as Cas9, Cpf1) variants according to the invention preferably have a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an amino acid sequence of the respective naturally occurring (wild-type) CRISPR-associated protein (such as Cas9, Cpf1), or a homolog, fragment or derivative thereof.

Fragments

Each CRISPR-associated protein exemplified herein (such as Cas9, Cpf1) preferably also encompasses fragments thereof.

The term "fragment" refers to a protein or polypeptide that consists of a continuous subsequence of the full-length amino acid sequence of a reference (or "parent") protein or (poly-)peptide, which is, with regard to its amino acid sequence, N-terminally, C-terminally and/or intrasequentially truncated compared to the amino acid sequence of said reference protein. Such truncation may occur either on the amino acid level or on the nucleic acid level, respectively. In other words, a "fragment" may typically be a shorter portion of a full-length sequence of an amino acid sequence. Accordingly, a fragment, typically, consists of a sequence that is identical to the corresponding stretch within the full-length amino acid sequence. The term includes naturally occurring fragments (such as fragments resulting from naturally occurring in vivo protease activity) as well as engineered fragments.

The term "fragment" as used herein may refer to a peptide or polypeptide comprising an amino acid sequence of at least 5 contiguous amino acid residues, at least 10 contiguous amino acid residues, at least 15 contiguous amino acid residues, at least 20 contiguous amino acid residues, at least 25 contiguous amino acid residues, at least 40 contiguous amino acid residues, at least 50 contiguous amino acid residues, at least 60 contiguous amino residues, at least 70 contiguous amino acid residues, at least contiguous 80 amino acid residues, at least contiguous 90 amino acid residues, at least contiguous 100 amino acid residues, at least contiguous 125 amino acid residues, at least 150 contiguous amino acid residues, at least contiguous 175 amino acid residues, at least contiguous 200 amino acid residues, or at least contiguous 250 amino acid residues of the amino acid sequence of a CRISPR-associated protein as defined herein, or a homolog, variant or derivative thereof.

A preferred fragment of a sequence in the context of the present invention, consists of a continuous stretch of amino acids corresponding to a continuous stretch of entities in the protein the fragment is derived from, which represents at least 20%, preferably at least 30%, more preferably at least 40%, more preferably at least 50%, even more preferably at least 60%, even more preferably at least 70%, and most preferably at least 80% of the total (i.e. full-length) protein or (poly-)peptide from which the fragment is derived.

A sequence identity indicated with respect to such a fragment preferably refers to the entire amino acid sequence of the reference protein or to the entire nucleic acid sequence encoding said reference protein. Preferably, a "fragment" of a CRISPR-associated protein (such as Cas9 or Cpf1), or a homolog, variant or derivative thereof, may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with the amino acid sequence of said CRISPR-associated protein (e.g. Cas9, Cpf1), or said homolog, variant or derivative.

Derivatives

Each CRISPR-associated protein exemplified herein (such as Cas9, Cpf1) preferably also encompasses derivatives thereof.

The term "derivative", when referring to proteins, is to be understood as a protein that has been modified with respect to a reference (or "parent") protein to include a new or additional property or functionality. Derivatives may be modified to comprise desired biological functionalities (e.g. by introducing or removing moieties or domains that confer, enhance, reduce or abolish target binding affinity or specificity or enzymatic activities), manufacturing properties (e.g. by introducing moieties which confer an increased solubility or enhanced excretion, or allow for purification) or pharmacokinetic/pharmacodynamics properties for medical use (e.g. by introducing moieties which confer increased stability, bioavailability, absorption; distribution and/or reduced clearance). Derivatives may be prepared by introducing or removing a moiety or domain that confers a biological property or functionality of interest. Such moieties or domains may be introduced into the amino acid sequence (e.g. at the amino and/or carboxyl terminal residues) post-translationally or at the nucleic acid sequence level using standard genetic engineering techniques (cf. Sambrook 3 et al., 2012 (4th ed.), Molecular cloning: a laboratory manual. Cold Spring Harbor Laboratory, Cold Spring Harbor, N.Y.). A "derivative" may be derived from (and thus optionally include) the naturally occurring (wild-type) CRISPR-associated protein sequence, or a variant or fragment thereof.

It will be understood that CRISPR-associated protein derivatives may differ (e.g. by way of introduction or removal of (poly-)peptide moieties and/or protein domains) in their amino acid sequence from the reference protein they are derived from, and thus may qualify as "variants" as well. However, whereas sequence variants are primarily defined in terms of their sequence identity to a reference amino acid sequence, derivatives are preferably characterized by the presence or absence of a specific biological property or functionality as compared to the reference protein.

Many CRISPR-associated protein derivatives are based on variants, fragments, fragment variants or variant fragments of the respective naturally occurring (wild-type) CRISPR-associated proteins. For instance, CRISPR-associated protein derivatives according to the invention may include derivatives based on engineered protein variants comprising mutations that abolish endonuclease and/or nickase activity, that have been further engineered to include effector or adaptor domains conferring new or additional biological properties or functionalities.

In preferred embodiments, the artificial nucleic acid molecule of the invention thus encodes a CRISPR-associated protein (e.g. Cas9, Cpf1) derivative as defined herein, wherein said derivative comprises at least one further effector domain.

An "effector domain" is to be understood as a protein moiety that confers an additional and/or new biological property or functionality. In the context of the present invention, effector domains may be selected based on their capability of conferring a (new or additional) biological function to the CRISPR-associated protein, preferably without interfering with its ability to associate with a suitable guide RNA to specifically interact with a target DNA sequence. The new or additional biological function may be, for instance, transcriptional repression (inducing CRISPR interference, CRISPRI) or activation (inducing CRISPR activation, CRISPRa). Effector domains of interest in the context of the present invention may thus be selected from transcriptional repressor domains, including Krüppel associated box (KRAB) domains, MAX-interacting protein 1 (MXI1) domains, four concatenated mSin3 (SID4×) domains, or transcription activation domains, including herpes simplex VP16 activation domains (VP64 or VP160), nuclear factor-κB (NF-κB) transactivating subunit activation domain (p65AD). Such effector domain(s) can be fused to either amino (N—) or carboxyl (C—) termini of the CRISPR-associated protein, or both. With suitable effector domains, transcription can also be regulated at the epigenetic level. Histone demethylase LSD1 removes the histone 3 Lys4 dimethylation (H3K4me2) mark from targeted distal enhancers, leading to transcription repression. The catalytic core of the histone acetyltransferase p300 (p300Core) can acetylate H3K27 (H3K27ac) at targeted proximal and distal enhancers, which leads to transcription activation. The new or additional biological functionality may, additionally or alternatively, be the recruitment of effector domains of interest. To that end, the effector domain may be a "recruiting domain", preferably a protein-protein interaction domain or motif, such as WRPW (Trp-Arg-Pro-Trp) motifs (Fisher et al. Mol Cell Biol. 1996 June; 16(6):2670-7). The new or additional biological function may, additionally or alternatively, be the recruitment of other entities of interest, such as RNAs. To that end, the effector domain may be selected from protein-RNA interaction domains, such as a cold shock domain (CSD).

CRISPR-associated protein derivatives comprising an effector domain thus include (a) CRISPR-associated proteins (or homologs, variants, fragments thereof) that are directly fused to (optionally via a suitable linker) effector domains capable of interacting with the target DNA sequence (or regulatory elements operably linked thereto) and (b) CRISPR-associated proteins (or homologs, variants, fragments thereof) that are fused to (optionally via a suitable linker) effector domains that recruit further effectors (domains, proteins or nucleic acids) of interest, that are, in turn, able to interact with the target DNA sequence (or regulatory elements operably linked thereto).

Effector domains can be fused to CRISPR-associated proteins (or variants or fragments thereof), optionally via a suitable (peptide) linker, using standard techniques of genetic engineering (cf. Sambrook J et al., 2012 (4$^{th}$ ed.), Molecular cloning: a laboratory manual. Cold Spring Harbor Laboratory, Cold Spring Harbor, N.Y.).

Peptide linkers of interest are generally known in the art and can be classified into three types: flexible linkers, rigid linkers, and cleavable linkers. Flexible linkers are usually applied when the joined domains require a certain degree of movement or interaction, and are therefore of particular interest in the context of CRISPR-associated protein derivatives of the present invention. They are generally rich in small, non-polar (e.g. Gly) or polar (e.g. Ser or Thr) amino acids to provide good flexibility and solubility, and allow for mobility of the connected protein domains. The incorporation of Ser or Thr may maintain the stability of the linker in aqueous solutions by forming hydrogen bonds with water molecules, and therefore reduces unfavorable interactions between the linker and the protein moieties.

The most commonly used flexible linkers have sequences consisting primarily of stretches of Gly and Ser residues ("GS" linker). An example of the most widely used flexible linker has the sequence of (Gly-Gly-Gly-Gly-Ser)n. By adjusting the copy number "n", the length of this GS linker can be optimized to achieve appropriate separation of the protein domains, or to maintain necessary inter-domain interactions. Besides the GS linkers, many other flexible linkers have been designed for recombinant fusion proteins. These flexible linkers are also rich in small or polar amino acids such as Gly and Ser, but may contain additional amino acids such as Thr and Ala to maintain flexibility, as well as polar amino acids such as Lys and Glu to improve solubility.

Several other types of flexible linkers, including KES-GSVSSEQLAQFRSLD, EGKSSGSGSESKST, and GSAGSAAGSGEF have been applied for the construction fusion proteins. Other flexible linkers include glycine-only linkers (Gly)$_6$ or (Gly)$_8$.

Rigid linkers may be employed when separation of the protein domains and reduction of their interference is to be ensured. Cleavable linkers, on the other hand, can be introduced to release free functional domains in vivo. Chen et al. Adv Drug Deliv Rev. 2013 Oct. 15; 65(10): 1357-1369 reviews the most commonly used peptide linkers and their applications, and is incorporated herein by reference in its entirety.

Besides fusing the desired effector domains to the CRISPR-associated protein, there are several alternative approaches for mediating a desired biological effect on a target sequence of interest. These approaches essentially utilize CRISPR-associated proteins (or guide RNAs) that are able to recruit effector domains of interest to the target DNA sequence. These approaches may provide additional options and flexibility for multiplex recruitment of effector domains to a specific target DNA sequence of interest (such as a promoter or enhancer).

The SunTag activation method uses an array of small peptide epitope tags fused a CRISPR-associated protein (e.g. dCas9) to recruit multiple copies of single-chain variable fragment (scFV) fused to super folder GFP (sfGFP; for improving protein folding), fused to (an) effector domain(s), e.g. VP64. The synergistic tripartite activation method (VPR) uses a tandem fusion of three effector domains (e.g. transcription activators, VP64, p65 and the Epstein-Barr virus R transactivator (Rta)), to confer the desired biological functionality. The aptamer-based recruitment system (synergistic activation mediator (SAM)) utilizes a CRISPR-associated protein (e.g. dCas9) with a guide RNA with two binding sites (for instance, RNA aptamers at the tetraloop and the second stem-loop) to recruit the phage MS2 coat protein (MCP) that is fused to effector domains (e.g. transcriptional activators, such as p65 and heat shock factor 1 (HSF1)). Additionally, further effector domains (e.g. VP64) may be fused to the CRISPR-associated protein, yielding a derivative in accordance with the present invention.

The activation methods described above can be readily adapted to confer transcriptional repression function, or other desired biological functionalities, to the CRISPR-associated proteins or their homologs, variants, fragments or derivatives as described herein. CRISPR-associated protein derivatives and various approaches for mediating CRISPRa and CRISPRi are reviewed in Dominguez et al. Nat Rev Mol Cell Biol. 2016 January; 17(1):5-15, which is incorporated by reference herein in its entirety.

Signal Peptides

In some embodiments, the artificial nucleic acid molecule, preferably RNA, of the invention comprises at least one nucleic acid sequence encoding signal peptide. Said nucleic acid sequence is preferably located within the coding region (encoding the CRISPR-associated protein) of the inventive artificial nucleic acid molecule. Therefore, the artificial nucleic acid molecule, preferably RNA, of the invention may preferably comprise a coding region encoding a CRISPR-associated protein as defined herein, or a homolog, variant, fragment or derivative thereof, comprising at least one signal peptide.

A signal peptide (sometimes referred to as signal sequence, targeting signal, localization signal, localization sequence, transit peptide, leader sequence or leader peptide) is typically a short (5-30 amino acids long) peptide preferably located at the N-terminus of the encoded CRISPR-associated protein (or a homolog, variant, fragment or derivative thereof).

Signal peptides preferably mediate the transport of the encoded CRISPR-associated protein (or a homolog, variant, fragment or derivative thereof) into a defined cellular compartment, e.g. the cell surface, the endoplasmic reticulum (ER) or the endosomal-lysosomal compartment. Signal peptides are therefore inter alia useful in order to facilitate excretion of expressed proteins from a production cell line.

Exemplary signal peptides envisaged in the context of the present invention include, without being limited thereto, signal sequences of classical or non-classical MHC-molecules (e.g. signal sequences of MHC I and II molecules, e.g. of the MHC class I molecule HLA-A*0201), signal sequences of cytokines or immunoglobulins, signal sequences of the invariant chain of immunoglobulins or antibodies, signal sequences of Lamp1, Tapasin, Erp57, Calretikulin, Calnexin, PLAT, EPO or albumin and further membrane associated proteins or of proteins associated with the endoplasmic reticulum (ER) or the endosomal-lysosomal compartment. Most preferably, signal sequences are derived from (human) HLA-A2, (human) PLAT, (human) sEPO, (human) ALB, (human) IgE-leader, (human) CD5, (human) IL2, (human) CTRB2, (human) IgG-HC, (human) Ig-HC, (human) Ig-LC, GpLuc, (human) Igkappa or a fragment or variant of any of the aforementioned proteins, in particular HLA-A2, HsPLAT, sHsEPO, HsALB, HsPLAT (aa1-21), HsPLAT(aa1-22), IgE-leader, HsCD5(aa1-24), HsIL2(aa1-20), HsCTRB2(aa1-18), IgG-HC(aa1-19), Ig-HC(aa1-19), Ig-LC(aa1-19), GpLuc(1-17) or MmIgkappa. The present invention envisages the use of the aforementioned signal sequences, or variants or fragments thereof, as long as these variants or fragments are functional, i.e. capable of targeting the CRISPR-associated protein to an (intra- or extra-)cellular location of interest.

The nucleic acid sequence encoding said signal peptide is preferably fused to the nucleic acid sequence encoding the CRISPR-associated protein (or its homolog, variant, fragment or derivative) in the coding region of the artificial nucleic acid of the invention by standard genetic engineering techniques (cf. Sambrook 3 et al., 2012 (4th ed.), Molecular cloning: a laboratory manual. Cold Spring Harbor Laboratory, Cold Spring Harbor, N.Y.). Expression of said coding region preferably yields a CRISPR-associated protein comprising (preferably at its N-terminus, C-terminus, or both), the encoded signal peptide.

Nuclear Localization Sequence (NLS)

The artificial nucleic acid molecule, preferably RNA, of the invention may preferably further comprise a nucleic acid sequence encoding at least one nuclear localization sequence (NLS). Said nucleic acid sequence is preferably located within the coding region (encoding the CRISPR-associated protein) of the inventive artificial nucleic acid molecule. Therefore, the artificial nucleic acid molecule, preferably RNA, of the invention may preferably comprise a coding region encoding a CRISPR-associated protein as defined herein, or a homolog, variant, fragment or derivative thereof, comprising at least one nuclear localization sequence (NLS).

A nuclear localization signal or sequence (NLS) is a short stretch of amino acids that mediates the transport of nuclear proteins into the nucleus. As CRISPR-associated proteins encoded by the artificial nucleic acids of the invention are particularly envisaged for therapy and research in mammalian cells, they may be endowed with at least one NLS in order to enable their import into the nucleus where they can take their effects on genomic DNA. The NLS preferably interacts with nuclear pore complexes (NPCs) in the nuclear envelope, thereby facilitating transport of the CRISPR-associated protein into the nucleus.

A variety of NLS sequences are known in the art, and their use (or adaptation for use) in accordance with the present invention is within the average skills and knowledge of the skilled person in the art. The best characterized transport signal is the classical NLS (cNLS) for nuclear protein import, which consists of either one (monopartite) or two (bipartite) stretches of basic amino acids. Typically, the monopartite motif is characterized by a cluster of basic residues preceded by a helix-breaking residue. Similarly, the bipartite motif consists of two clusters of basic residues separated by 9-12 residues. Monopartite cNLSs are exemplified by the SV40 large T antigen NLS ($^{126}$PKKKRRV$^{132}$; SEQ ID NO: 381) and bipartite cNLSs are exemplified by the nucleoplasmin NLS ($^{155}$KRPAATKKAGQAKKKK$^{170}$; SEQ ID NO: 382). Consecutive residues from the N-terminal lysine of the monopartite NLS are referred to as P1, P2, etc. Monopartite cNLS typically require a lysine in the P1 position, followed by basic residues in positions P2 and P4 to yield a loose consensus sequence of K(K/R)x(K/R) (SEQ ID NO: 384; Lange et al., J Biol Chem. 2007 Feb. 23; 282(8): 5101-5105).

It is therefore envisaged that according to preferred embodiments, the artificial nucleic acid molecule further comprises at least one nucleic acid sequence encoding a nuclear localization signals (NLS). The artificial nucleic acid molecule according to the invention may thus encode 1, 2, 3, 4, 5 or more NLSs, which are optionally selected from the NLS exemplified herein. Said NLS-encoding nucleic acid sequence is preferably located in the coding region of the artificial nucleic acid of the invention, and is preferably fused to the nucleic acid sequence encoding the CRISPR-associated protein, so that expression of said coding region yields a CRISPR-associated protein comprising said at least one NLS, preferably at its N-terminus, C-terminus, or both. In other words, the artificial nucleic acid molecule according to the invention may preferably encode a CRISPR-associated protein comprising at least one NLS, preferably at its N-terminus, C-terminus, or both.

A suitable NLS in accordance with the present invention may comprise or consist of an amino acid sequence according to SEQ ID NO: 426 (MAPKKKRKVGIHGVPAA), also referred to as NLS2 herein, which may be encoded by a nucleic acid sequence according to any one of SEQ ID NOs: 409; 2538, 1378; 3698; 4858; 6018; 7178; or 8338, or a (functional) variant or fragment of any of these sequences, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of those sequences. The present invention further envisages the use of variants or fragments of NLS2, provided that these variants and fragments are preferably functional, i.e. capable of mediating import of the CRISPR-associated protein into the nucleus. Such functional variants or fragments may comprise or consist of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to an amino acid sequence according to SEQ ID NO: 426.

Another suitable NLS in accordance with the present invention may comprise or consist of an amino acid sequence according to SEQ ID NO: 427 (KRPAATKK-AGQAKKKK), also referred to as NLS4 herein, which may be encoded by a nucleic acid sequence according to SEQ ID NO: 410; 2539; 1379; 3699; 4859; 6019; 7179; 8339, or a (functional) variant or fragment of any of these sequences, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences. The present invention further envisages the use of variants or fragments of NLS4, provided that these variants and fragments are preferably functional, i.e. capable of mediating import of the CRISPR-associated protein into the nucleus. Such functional variants or fragments may comprise or consist of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to an amino acid sequence according to SEQ ID NO: 427.

Another suitable NLS in accordance with the present invention may comprise or consist of an amino acid sequence according to SEQ ID NO: 427 (KRPAATKK-AGQAKKKK), also referred to as NLS4 herein, which may be encoded by a nucleic acid sequence according to SEQ ID NO: 410; 2539; 1379; 3699; 4859; 6019; 7179; 8339, or a (functional) variant or fragment of any of these sequences, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences. The present invention further envisages the use of variants or fragments of NLS4, provided that these variants and fragments are preferably functional, i.e. capable of mediating import of the CRISPR-associated protein into the nucleus. Such functional variants or fragments may comprise or consist of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to an amino acid sequence according to SEQ ID NO: 427.

It is further envisaged herein to equip the CRISPR-associated protein with two or more NLSs, and these NLSs may for instance be selected from NLS2 (characterized by SEQ ID NO: 426) and NLS4 (characterized by SEQ ID NO: 427) or a functional variant or fragment of either or both of these nuclear localization signals.

Another suitable NLS in accordance with the present invention may comprise or consist of an amino acid sequence according to SEQ ID NO: 10575 (KRPAATKK-AGQAKKKK), also referred to as NLS3 herein, which may be encoded by a nucleic acid sequence according to SEQ ID NO: 410; 2539 1379; 3699; 4859; 6019; 7179; 8339, 10551; 10581, 10593; 10584; 10587; 10590; 10593; 10596, or a (functional) variant or fragment of any of these sequences, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences. The present invention further envisages the use of variants or fragments of NLS3, provided that these variants and fragments are preferably functional, i.e. capable of mediating import of the CRISPR-associated protein into the nucleus. Such functional variants or fragments may comprise or consist of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to an amino acid sequence according to SEQ ID NO: 427.

Accordingly, further preferred NLS sequences may comprise or consist of an amino acid sequence according to SEQ ID NO:426; 427; 10575; 381; 382; 384; 11957; 11958-11964 which may be encoded by a nucleic acid sequence according to 409; 2538; 410; 2539; 10551; 10581; 11973; 11974-1198, 1378; 3698; 4858; 6018; 7178; 8338; 1379; 3699; 4859; 6019; 7179; 8339; 10593; 10584; 10587; 10590; 10593; 10596; 11965; 11981; 11989; 11997; 12005; 12013; 11966-11972; 11982-11988; 11990-11996; 11998-12004; 12006-12012; or 12014-12020.

Further preferred NLS may comprise or consist of an amino acid sequence according to SEQ ID NOs: 12021-14274.

The NLS sequences as described above are a non-limiting list of commonly used and accepted NLS. It is understood that any of the herein mentioned gene editing enzymes, f.e. Cas9 or Cpf1, may be combined with any other NLS as known in the art and with any number of NLS sequences in a sequence. Also combinations of different NLS-sequences are covered by the above disclosure of the invention.

Also comprised within the teaching of the invention are sequences encoding a gene editing protein as disclosed herein or in the sequence listing comprising any NLS as disclosed herein or known in the art in any number and/or combination of NLS (i.e. 5'/3' NLS).

Protein and Peptide Tags

In some embodiments, the artificial nucleic acid molecule, preferably RNA, of the invention further comprises at least one nucleic acid sequence encoding protein or peptide tag. Said nucleic acid sequence is preferably located within the coding region (encoding the CRISPR-associated protein) of the inventive artificial nucleic acid molecule. Therefore, the artificial nucleic acid molecule, preferably RNA, of the invention may preferably comprise a coding region encoding a CRISPR-associated protein as defined herein, or a homolog, variant, fragment or derivative thereof, comprising at least one protein or peptide tag.

Protein and peptide tags are amino acid sequences that can be introduced into proteins of interest to enable purification, detection, localization or for other purposes. Protein and peptide tags can be classified based on their function, and include, without limitation, affinity tags (such as chitin binding protein (CBP), maltose binding protein (MBP), glutathione-S-transferase (GST), poly(His) tags, Fc-tags, Strep-tags), solubilization tags (such as thioredoxin (TRX) and poly(NANP)), chromatography tags (such as FLAG-tags), epitope tags (V5-tag, Myc-tag, HA-tag and NE-tag), fluorescent tags (such as GFP-tags), or others (Av-tag, allows for biotinylation and subsequent isolation).

The artificial nucleic acid molecule according to the invention may thus encode 1, 2, 3, 4, 5 or more protein or peptide tags, which are optionally selected from the protein tags exemplified herein. Said protein or peptide tag-encoding nucleic acid sequence is preferably located in the coding region of the artificial nucleic acid molecule of the invention, and is preferably fused to the nucleic acid sequence encoding the CRISPR-associated protein, so that expression of said coding region yields a CRISPR-associated protein comprising said at least one protein or peptide tags. In other words, the artificial nucleic acid molecule according to the invention may preferably encode a CRISPR-associated protein comprising at least one protein or peptide tag. Means and methods for introducing nucleic acids encoding such protein or peptide tags are within the skills and common knowledge of the person skilled in the art.

The artificial nucleic acid molecule, preferably RNA, of the present invention, may encode a CRISPR-associated protein (such as Cas9, Cpf1) exhibiting any of the above features or characteristics, if suitable or necessary, in any combination with each other, however provided that the combined features or characteristics do not interfere with each other. Thus, the artificial nucleic acid molecule, in particular RNA, may encode any CRISPR-associated protein exemplified herein, or a homolog, variant, fragment or derivative thereof as defined herein, which may comprise one or more NLSs, and optionally one or more signal sequences and/or protein or peptide tags, provided that the encoded CRISPR-associated protein (and the NLS, signal sequence, protein/peptide tag) preferably retains its desired biological function or property, as defined above.

Also comprised within the teaching of the invention are all sequences having a protein or peptide tag without said tag sequence(s) which was (were) introduced for purification, detection, localization or for other purposes. In other words, a sequence which is disclosed in the sequence listing with a peptide or protein tag is also clearly comprised within the teaching of the invention when the tag sequence is removed. A skilled artisan is readily able to remove any tag sequence from a tagged protein sequence, i.e. to use also the sequences of the invention in an untagged form. The same is true for PolyC and Histone stem loop sequences which could easily be removed from or also added to the protein, if desired.

Cas9

"Cas9" refers to RNA-guided Type II CRISPR-Cas DNA endonucleases, which may be encoded by the *Streptococcus pyogenes* serotype M1 cas9 gene (NCBI Reference Sequence: NC_002737.2, "SPy1046"; *S. pyogenes*) i.e. spCas9, or a homolog, variant or fragment thereof. Cas9 can preferably be recruited by a guide RNA (gRNA) to cleave, site-specifically, a target DNA sequence using two distinct endonuclease domains (HNH and RuvC/RNase H-like domains), one for each strand of the DNA's double helix. RuvC and HNH together produce double-stranded breaks (DSBs), and separately can produce single-stranded breaks (U.S. Published Patent Application No. 2014-0068797 and Jinek M., et al. Science. 2012 Aug. 17; 337(6096):816-21). Cas9 is preferably capable of specifically recognizing (and preferably binding to) a protospacer adjacent motif (PAM) juxtaposed to the target DNA sequence. The PAM is typically located 3' of the target DNA any may comprise or consist of the three-nucleotide sequence NGG. It is typically recognized by the PAM-interacting domain (PI domain) located near the C-terminal end of Cas9.

A large number of Cas9 proteins are known in the art and are envisaged as CRISPR-associated proteins in the context of the present invention. Suitable Cas9 proteins are listed in Table 2 below. Therein, each row corresponds to a Cas9 protein as identified by the database accession number of the corresponding protein (first column, "A", "Acc No."). The second column in Table 2 ("B") indicates the SEQ ID NO: corresponding to the respective amino acid sequence as provided herein. Preferred Cas9 proteins are shown in the sequence listing under SEQ ID NO:428-441; SEQ ID NO:10999-11001; and SEQ ID NO:442-1345. The corresponding optimized mRNA sequences which are preferred embodiment of the invention are shown in the sequence listing under SEQ ID NO:411; 2540-2553; 11117-11119; 11355-11357; 2554-3457; 1380-1393; 3700-3713; 4860-4873; 6020-6033; 7180-7193; 8340-8353; 11237-11239; 11473-11475; 11591-11593; 11709-11711; 11827-11829; 11945-11947; 1394-2297; 3714-4617; 4874-5777; 6034-6937; 7194-8097; and 8354-9257.

Amino Acid Sequences

TABLE 2

Cas9 proteins of the invention

| Row | Column A Protein Acc. No. | Protein (Cas9/Cpf1) | Column B SEQ ID NO |
|---|---|---|---|
| 1 | Q99ZW2 | Cas9_Q99ZW2_prot | 428 |
| 2 | A0Q5Y3 | Cas9_A0Q5Y3_prot | 429 |
| 3 | J7RUA5 | Cas9_J7RUA5_prot | 430 |
| 4 | G3ECR1 | Cas9_G3ECR1_prot | 431 |
| 5 | J3F2B0 | Cas9_J3F2B0_prot | 432 |
| 6 | Q03JI6 | Cas9_Q03JI6_prot | 433 |
| 7 | C9X1G5 | Cas9_C9X1G5_prot | 434 |
| 8 | Q927P4 | Cas9_Q927P4_prot | 435 |
| 9 | Q8DTE3 | Cas9_Q8DTE3_prot | 436 |
| 10 | Q9CLT2 | Cas9_Q9CLT2_prot | 437 |
| 11 | A1IQ68 | Cas9_A1IQ68_prot | 438 |
| 12 | Q6NKI3 | Cas9_Q6NKI3_prot | 439 |
| 13 | Q0P897 | Cas9_Q0P897_prot | 440 |
| 14 | Q03LF7 | Cas9_Q03LF7_prot | 441 |
| 15 | T0TDV9 | Cas9_T0TDV9_prot | 442 |
| 16 | A0A0D8BYB2 | Cas9_A0A0D8BYB2_prot | 443 |
| 17 | A0A0M4TTU2 | Cas9_A0A0M4TTU2_prot | 444 |
| 18 | A7H5P1 | Cas9_A7H5P1_prot | 445 |
| 19 | A0A0W8KZ82 | Cas9_A0A0W8KZ82_prot | 446 |
| 20 | A0A0E1ZMQ3 | Cas9_A0A0E1ZMQ3_prot | 447 |
| 21 | W8KE67 | Cas9_W8KE67_prot | 448 |
| 22 | A0A0B6V308 | Cas9_A0A0B6V308_prot | 449 |
| 23 | A0A1E7PM50 | Cas9_A0A1E7PM50_prot | 450 |
| 24 | A0A1E7P6J5 | Cas9_A0A1E7P6J5_prot | 451 |
| 25 | A0A1D9BML5 | Cas9_A0A1D9BML5_prot | 452 |
| 26 | A5KEK9 | Cas9_A5KEK9_prot | 453 |
| 27 | D2MWB9 | Cas9_D2MWB9_prot | 454 |
| 28 | A0A0H4KTI1 | Cas9_A0A0H4KTI1_prot | 455 |
| 29 | A0A0D7V4T2 | Cas9_A0A0D7V4T2_prot | 456 |
| 30 | A0A059HXJ1 | Cas9_A0A059HXJ1_prot | 457 |
| 31 | A0A1E7NYV5 | Cas9_A0A1E7NYV5_prot | 458 |
| 32 | A0A1E7P943 | Cas9_A0A1E7P943_prot | 459 |
| 33 | A0A0E2UY67 | Cas9_A0A0E2UY67_prot | 460 |
| 34 | A0A1B3X857 | Cas9_A0A1B3X857_prot | 461 |
| 35 | A0A0E9LLC5 | Cas9_A0A0E9LLC5_prot | 462 |
| 36 | A0A125S8M1 | Cas9_A0A125S8M1_prot | 463 |
| 37 | A0A0S8HUJ8 | Cas9_A0A0S8HUJ8_prot | 464 |
| 38 | A0A0A8GXC3 | Cas9_A0A0A8GXC3_prot | 465 |

TABLE 2-continued

Cas9 proteins of the invention

| Row | Column A<br>Protein Acc. No. | Protein (Cas9/Cpf1) | Column B<br>SEQ ID NO |
|---|---|---|---|
| 39 | A0A0A8GU36 | Cas9__A0A0A8GU36__prot | 466 |
| 40 | A0A139BVD9 | Cas9__A0A139BVD9__prot | 467 |
| 41 | A3VED0 | Cas9__A3VED0__prot | 468 |
| 42 | A0A0A8HTA3 | Cas9__A0A0A8HTA3__prot | 469 |
| 43 | A0A125S8L7 | Cas9__A0A125S8L7__prot | 470 |
| 44 | T2LKS6 | Cas9__T2LKS6__prot | 471 |
| 45 | A0A0A8H849 | Cas9__A0A0A8H849__prot | 472 |
| 46 | F5S4M8 | Cas9__F5S4M8__prot | 473 |
| 47 | G1UFN3 | Cas9__G1UFN3__prot | 474 |
| 48 | B5ZLK9 | Cas9__B5ZLK9__prot | 475 |
| 49 | C5ZYI3 | Cas9__C5ZYI3__prot | 476 |
| 50 | A0A0G3EK96 | Cas9__A0A0G3EK96__prot | 477 |
| 51 | A0A125S8M5 | Cas9__A0A125S8M5__prot | 478 |
| 52 | A0A0L6CQ85 | Cas9__A0A0L6CQ85__prot | 479 |
| 53 | A0A0L8B0U9 | Cas9__A0A0L8B0U9__prot | 480 |
| 54 | A0A178N1Y8 | Cas9__A0A178N1Y8__prot | 481 |
| 55 | A0A125S8I0 | Cas9__A0A125S8I0__prot | 482 |
| 56 | A0A0A1PPJ7 | Cas9__A0A0A1PPJ7__prot | 483 |
| 57 | B8I0 85 | Cas9__B8I0 85__prot | 484 |
| 58 | A0A1B8J9V3 | Cas9__A0A1B8J9V3__prot | 485 |
| 59 | I7GTK8 | Cas9__I7GTK8__prot | 486 |
| 60 | D3UFL8 | Cas9__D3UFL8__prot | 487 |
| 61 | E1VQA3 | Cas9__E1VQA3__prot | 488 |
| 62 | M4V7E7 | Cas9__M4V7E7__prot | 489 |
| 63 | F4GDP9 | Cas9__F4GDP9__prot | 490 |
| 64 | A0A0Q6WIJ3 | Cas9__A0A0Q6WIJ3__prot | 491 |
| 65 | A0A0E9L8G0 | Cas9__A0A0E9L8G0__prot | 492 |
| 66 | A0A0A1VBC9 | Cas9__A0A0A1VBC9__prot | 493 |
| 67 | B1GZM3 | Cas9__B1GZM3__prot | 494 |
| 68 | A0A1C0W3U5 | Cas9__A0A1C0W3U5__prot | 495 |
| 69 | D5BR51 | Cas9__D5BR51__prot | 496 |
| 70 | A0A1A7NZJ6 | Cas9__A0A1A7NZJ6__prot | 497 |
| 71 | A0A125S8J2 | Cas9__A0A125S8J2__prot | 498 |
| 72 | A0A0A2YBT2 | Cas9__A0A0A2YBT2__prot | 499 |
| 73 | A0A099UFG2 | Cas9__A0A099UFG2__prot | 500 |
| 74 | A0A0C5JLX1 | Cas9__A0A0C5JLX1__prot | 501 |
| 75 | A7HP89 | Cas9__A7HP89__prot | 502 |
| 76 | A0A0J6BUV9 | Cas9__A0A0J6BUV9__prot | 503 |
| 77 | A0A1C9ZTA2 | Cas9__A0A1C9ZTA2__prot | 504 |
| 78 | A0A087N7M8 | Cas9__A0A087N7M8__prot | 505 |
| 79 | A0A0Q9CTQ5 | Cas9__A0A0Q9CTQ5__prot | 506 |
| 80 | A0A101I188 | Cas9__A0A101I188__prot | 507 |
| 81 | V2Q0I9 | Cas9__V2Q0I9__prot | 508 |
| 82 | F9ZKQ5 | Cas9__F9ZKQ5__prot | 509 |
| 83 | F0Q2T1 | Cas9__F0Q2T1__prot | 510 |
| 84 | M4R7E0 | Cas9__M4R7E0__prot | 511 |
| 85 | T1DV82 | Cas9__T1DV82__prot | 512 |
| 86 | W0Q6X6 | Cas9__W0Q6X6__prot | 513 |
| 87 | A0A0E9MLX9 | Cas9__A0A0E9MLX9__prot | 514 |
| 88 | A0A0D6MWC5 | Cas9__A0A0D6MWC5__prot | 515 |
| 89 | A0A087MCH0 | Cas9__A0A087MCH0__prot | 516 |
| 90 | I3TWJ0 | Cas9__I3TWJ0__prot | 517 |
| 91 | A0A011P7F8 | Cas9__A0A011P7F8__prot | 518 |
| 92 | A0A163RXL7 | Cas9__A0A163RXL7__prot | 519 |
| 93 | A9HKP2 | Cas9__A9HKP2__prot | 520 |
| 94 | A0A0N1EBR4 | Cas9__A0A0N1EBR4__prot | 521 |
| 95 | A0A0A8HLU7 | Cas9__A0A0A8HLU7__prot | 522 |
| 96 | E1W6G3 | Cas9__E1W6G3__prot | 523 |
| 97 | J4KDT3 | Cas9__J4KDT3__prot | 524 |
| 98 | E3CY56 | Cas9__E3CY56__prot | 525 |
| 99 | J7RUA5 | Cas9__J7RUA5__prot | 526 |
| 100 | A0A151A3A4 | Cas9__A0A151A3A4__prot | 527 |
| 101 | A0A1E5TL62 | Cas9__A0A1E5TL62__prot | 528 |
| 102 | M4S2X5 | Cas9__M4S2X5__prot | 529 |
| 103 | E0F2V7 | Cas9__E0F2V7__prot | 530 |
| 104 | A0A0N7KBI5 | Cas9__A0A0N7KBI5__prot | 531 |
| 105 | A0A133QCR3 | Cas9__A0A133QCR3__prot | 532 |
| 106 | K0G350 | Cas9__K0G350__prot | 533 |
| 107 | U5ULJ7 | Cas9__U5ULJ7__prot | 534 |
| 108 | F0ET08 | Cas9__F0ET08__prot | 535 |
| 109 | A0A0S2F228 | Cas9__A0A0S2F228__prot | 536 |
| 110 | A0A060QC50 | Cas9__A0A060QC50__prot | 537 |
| 111 | C5S1N0 | Cas9__C5S1N0__prot | 538 |
| 112 | A0A0K1NCD0 | Cas9__A0A0K1NCD0__prot | 539 |
| 113 | A0A099TTS6 | Cas9__A0A099TTS6__prot | 540 |

TABLE 2-continued

Cas9 proteins of the invention

| Row | Column A<br>Protein Acc. No. | Protein (Cas9/Cpf1) | Column B<br>SEQ ID NO |
|---|---|---|---|
| 114 | A0A0D2SXK1 | Cas9__A0A0D2SXK1__prot | 541 |
| 115 | A0A1E4MWW9 | Cas9__A0A1E4MWW9__prot | 542 |
| 116 | A0A0M3VQX7 | Cas9__A0A0M3VQX7__prot | 543 |
| 117 | A0A0T0PVC7 | Cas9__A0A0T0PVC7__prot | 544 |
| 118 | Q7MRD3 | Cas9__Q7MRD3__prot | 545 |
| 119 | A0A160JE60 | Cas9__A0A160JE60__prot | 546 |
| 120 | J6LE60 | Cas9__J6LE60__prot | 547 |
| 121 | A0A0P1D4L3 | Cas9__A0A0P1D4L3__prot | 548 |
| 122 | A0A176I8B4 | Cas9__A0A176I8B4__prot | 549 |
| 123 | A0A143DGZ8 | Cas9__A0A143DGZ8__prot | 550 |
| 124 | G2ZYP2 | Cas9__G2ZYP2__prot | 551 |
| 125 | A6VLA7 | Cas9__A6VLA7__prot | 552 |
| 126 | A0A151APJ0 | Cas9__A0A151APJ0__prot | 553 |
| 127 | V9H606 | Cas9__V9H606__prot | 554 |
| 128 | A0A0D6XNZ8 | Cas9__A0A0D6XNZ8__prot | 555 |
| 129 | Q13CC2 | Cas9__Q13CC2__prot | 556 |
| 130 | A5EIM8 | Cas9__A5EIM8__prot | 557 |
| 131 | B1UZL4 | Cas9__B1UZL4__prot | 558 |
| 132 | B1BJM3 | Cas9__B1BJM3__prot | 559 |
| 133 | Q20XX4 | Cas9__Q20XX4__prot | 560 |
| 134 | A0A125S8L3 | Cas9__A0A125S8L3__prot | 561 |
| 135 | A0A0B8Z713 | Cas9__A0A0B8Z713__prot | 562 |
| 136 | A0A150D6Y2 | Cas9__A0A150D6Y2__prot | 563 |
| 137 | A1WH93 | Cas9__A1WH93__prot | 564 |
| 138 | R8LDU5 | Cas9__R8LDU5__prot | 565 |
| 139 | A0A0F7K1T5 | Cas9__A0A0F7K1T5__prot | 566 |
| 140 | R8NC81 | Cas9__R8NC81__prot | 567 |
| 141 | A0A0P7L7M3 | Cas9__A0A0P7L7M3__prot | 568 |
| 142 | F0PZE9 | Cas9__F0PZE9__prot | 569 |
| 143 | C2UN05 | Cas9__C2UN05__prot | 570 |
| 144 | T0HC86 | Cas9__T0HC86__prot | 571 |
| 145 | R5QL13 | Cas9__R5QL13__prot | 572 |
| 146 | A0A0J0YQ19 | Cas9__A0A0J0YQ19__prot | 573 |
| 147 | A0A196P6K7 | Cas9__A0A196P6K7__prot | 574 |
| 148 | R6QL84 | Cas9__R6QL84__prot | 575 |
| 149 | A0A0J5QZM1 | Cas9__A0A0J5QZM1__prot | 576 |
| 150 | A0A0P1ETF1 | Cas9__A0A0P1ETF1__prot | 577 |
| 151 | A0A125S8J5 | Cas9__A0A125S8J5__prot | 578 |
| 152 | A0A1C6WUG4 | Cas9__A0A1C6WUG4__prot | 579 |
| 153 | A0A1D3QUT4 | Cas9__A0A1D3QUT4__prot | 580 |
| 154 | F2B8K0 | Cas9__F2B8K0__prot | 581 |
| 155 | A0A1D3PTA0 | Cas9__A0A1D3PTA0__prot | 582 |
| 156 | A0A0P7LDT0 | Cas9__A0A0P7LDT0__prot | 583 |
| 157 | A0A0R1LQW1 | Cas9__A0A0R1LQW1__prot | 584 |
| 158 | A0A159Z911 | Cas9__A0A159Z911__prot | 585 |
| 159 | R5Y7W7 | Cas9__R5Y7W7__prot | 586 |
| 160 | A8LN05 | Cas9__A8LN05__prot | 587 |
| 161 | S0RVL7 | Cas9__S0RVL7__prot | 588 |
| 162 | W1K9F9 | Cas9__W1K9F9__prot | 589 |
| 163 | A0A1E4DUI9 | Cas9__A0A1E4DUI9__prot | 590 |
| 164 | A0A1E4F4V8 | Cas9__A0A1E4F4V8__prot | 591 |
| 165 | J8W240 | Cas9__J8W240__prot | 592 |
| 166 | C6SFU3 | Cas9__C6SFU3__prot | 593 |
| 167 | C5TLV5 | Cas9__C5TLV5__prot | 594 |
| 168 | A0A0Y5JFG8 | Cas9__A0A0Y5JFG8__prot | 595 |
| 169 | A0A125S8I7 | Cas9__A0A125S8I7__prot | 596 |
| 170 | E4ZF34 | Cas9__E4ZF34__prot | 597 |
| 171 | A0A0Y6L5Q1 | Cas9__A0A0Y6L5Q1__prot | 598 |
| 172 | A0A0T7L299 | Cas9__A0A0T7L299__prot | 599 |
| 173 | X5EPV9 | Cas9__X5EPV9__prot | 600 |
| 174 | C6SH44 | Cas9__C6SH44__prot | 601 |
| 175 | E0NB23 | Cas9__E0NB23__prot | 602 |
| 176 | A9M1K5 | Cas9__A9M1K5__prot | 603 |
| 177 | D0W2Z9 | Cas9__D0W2Z9__prot | 604 |
| 178 | R0TXT9 | Cas9__R0TXT9__prot | 605 |
| 179 | C6S593 | Cas9__C6S593__prot | 606 |
| 180 | A0A1A6FJT6 | Cas9__A0A1A6FJT6__prot | 607 |
| 181 | A0A0D8IYR9 | Cas9__A0A0D8IYR9__prot | 608 |
| 182 | A0A0W7TPK7 | Cas9__A0A0W7TPK7__prot | 609 |
| 183 | G9RUL1 | Cas9__G9RUL1__prot | 610 |
| 184 | A0A0N8K819 | Cas9__A0A0N8K819__prot | 611 |
| 185 | A0A0Q7HTH3 | Cas9__A0A0Q7HTH3__prot | 612 |
| 186 | A0A0Q0YQ33 | Cas9__A0A0Q0YQ33__prot | 613 |
| 187 | E8LGQ1 | Cas9__E8LGQ1__prot | 614 |
| 188 | A0A0K1KC97 | Cas9__A0A0K1KC97__prot | 615 |

TABLE 2-continued

Cas9 proteins of the invention

| Row | Column A<br>Protein Acc. No. | Protein (Cas9/Cpf1) | Column B<br>SEQ ID NO |
|---|---|---|---|
| 189 | A0A150MM34 | Cas9__A0A150MM34__prot | 616 |
| 190 | H7F839 | Cas9__H7F839__prot | 617 |
| 191 | A0A178TEJ9 | Cas9__A0A178TEJ9__prot | 618 |
| 192 | A0A150MP45 | Cas9__A0A150MP45__prot | 619 |
| 193 | A0A164FEH7 | Cas9__A0A164FEH7__prot | 620 |
| 194 | V6VHM9 | Cas9__V6VHM9__prot | 621 |
| 195 | A0A096BCZ5 | Cas9__A0A096BCZ5__prot | 622 |
| 196 | A0A0J8GDE4 | Cas9__A0A0J8GDE4__prot | 623 |
| 197 | G9QLF2 | Cas9__G9QLF2__prot | 624 |
| 198 | D7N2B0 | Cas9__D7N2B0__prot | 625 |
| 199 | S5ZZV3 | Cas9__S5ZZV3__prot | 626 |
| 200 | A0A0N1BZF2 | Cas9__A0A0N1BZF2__prot | 627 |
| 201 | A0A0C9MY24 | Cas9__A0A0C9MY24__prot | 628 |
| 202 | A0A1C7NZW8 | Cas9__A0A1C7NZW8__prot | 629 |
| 203 | H0UDA8 | Cas9__H0UDA8__prot | 630 |
| 204 | E3HCA8 | Cas9__E3HCA8__prot | 631 |
| 205 | A0A073IJU3 | Cas9__A0A073IJU3__prot | 632 |
| 206 | W3RQ02 | Cas9__W3RQ02__prot | 633 |
| 207 | A0A0U2W148 | Cas9__A0A0U2W148__prot | 634 |
| 208 | G4CMU0 | Cas9__G4CMU0__prot | 635 |
| 209 | A0A0H1A177 | Cas9__A0A0H1A177__prot | 636 |
| 210 | A0A125S8L4 | Cas9__A0A125S8L4__prot | 637 |
| 211 | A0A0T2NHL9 | Cas9__A0A0T2NHL9__prot | 638 |
| 212 | A0A1A9FXI0 | Cas9__A0A1A9FXI0__prot | 639 |
| 213 | A0A139DPY2 | Cas9__A0A139DPY2__prot | 640 |
| 214 | A0A1A7V637 | Cas9__A0A1A7V637__prot | 641 |
| 215 | R5KSL2 | Cas9__R5KSL2__prot | 642 |
| 216 | R7B4M2 | Cas9__R7B4M2__prot | 643 |
| 217 | A0A143X3E0 | Cas9__A0A143X3E0__prot | 644 |
| 218 | R6DVD3 | Cas9__R6DVD3__prot | 645 |
| 219 | W0A9N2 | Cas9__W0A9N2__prot | 646 |
| 220 | R5UJK1 | Cas9__R5UJK1__prot | 647 |
| 221 | A5Z395 | Cas9__A5Z395__prot | 648 |
| 222 | A0A0X1TKX4 | Cas9__A0A0X1TKX4__prot | 649 |
| 223 | R7A6L3 | Cas9__R7A6L3__prot | 650 |
| 224 | J2WFY6 | Cas9__J2WFY6__prot | 651 |
| 225 | W1SA26 | Cas9__W1SA26__prot | 652 |
| 226 | A0A099UAI1 | Cas9__A0A099UAI1__prot | 653 |
| 227 | U2XW20 | Cas9__U2XW20__prot | 654 |
| 228 | R6ACK8 | Cas9__R6ACK8__prot | 655 |
| 229 | C4ZA16 | Cas9__C4ZA16__prot | 656 |
| 230 | A0A133XDM2 | Cas9__A0A133XDM2__prot | 657 |
| 231 | V8C5L2 | Cas9__V8C5L2__prot | 658 |
| 232 | E4MSY6 | Cas9__E4MSY6__prot | 659 |
| 233 | A0A0A1H768 | Cas9__A0A0A1H768__prot | 660 |
| 234 | A0A0Q7WLY8 | Cas9__A0A0Q7WLY8__prot | 661 |
| 235 | A0A0R1JQF2 | Cas9__A0A0R1JQF2__prot | 662 |
| 236 | A0A142LIG4 | Cas9__A0A142LIG4__prot | 663 |
| 237 | R2S872 | Cas9__R2S872__prot | 664 |
| 238 | A0A0E2RF34 | Cas9__A0A0E2RF34__prot | 665 |
| 239 | A0A0R1IXU4 | Cas9__A0A0R1IXU4__prot | 666 |
| 240 | A0A0E2Q4M6 | Cas9__A0A0E2Q4M6__prot | 667 |
| 241 | A0A139MDP4 | Cas9__A0A139MDP4__prot | 668 |
| 242 | X8HGN9 | Cas9__X8HGN9__prot | 669 |
| 243 | A0A1C3YEE6 | Cas9__A0A1C3YEE6__prot | 670 |
| 244 | A0A0P6UEB3 | Cas9__A0A0P6UEB3__prot | 671 |
| 245 | A0A0M3RT06 | Cas9__A0A0M3RT06__prot | 672 |
| 246 | K0ZVL9 | Cas9__K0ZVL9__prot | 673 |
| 247 | R0P7Y6 | Cas9__R0P7Y6__prot | 674 |
| 248 | S0KIG9 | Cas9__S0KIG9__prot | 675 |
| 249 | A0A081Q0Q9 | Cas9__A0A081Q0Q9__prot | 676 |
| 250 | F8LWC5 | Cas9__F8LWC5__prot | 677 |
| 251 | I0SS54 | Cas9__I0SS54__prot | 678 |
| 252 | A0A125S8J6 | Cas9__A0A125S8J6__prot | 679 |
| 253 | V8LWT4 | Cas9__V8LWT4__prot | 680 |
| 254 | A0A111NJ61 | Cas9__A0A111NJ61__prot | 681 |
| 255 | A0A0A0DHL5 | Cas9__A0A0A0DHL5__prot | 682 |
| 256 | Q5M542 | Cas9__Q5M542__prot | 683 |
| 257 | A0A0Z8LKF1 | Cas9__A0A0Z8LKF1__prot | 684 |
| 258 | A0A126UMM8 | Cas9__A0A126UMM8__prot | 685 |
| 259 | A0A0N8VNG6 | Cas9__A0A0N8VNG6__prot | 686 |
| 260 | A0A081PRN2 | Cas9__A0A081PRN2__prot | 687 |
| 261 | T1ZF93 | Cas9__T1ZF93__prot | 688 |
| 262 | A0A125S8J9 | Cas9__A0A125S8J9__prot | 689 |
| 263 | A0A0H4LAU6 | Cas9__A0A0H4LAU6__prot | 690 |

TABLE 2-continued

Cas9 proteins of the invention

| Row | Column A<br>Protein Acc. No. | Protein (Cas9/Cpf1) | Column B<br>SEQ ID NO |
|---|---|---|---|
| 264 | A0A0P0N7J4 | Cas9__A0A0P0N7J4__prot | 691 |
| 265 | A0A1G0BAB7 | Cas9__A0A1G0BAB7__prot | 692 |
| 266 | F8LNX0 | Cas9__F8LNX0__prot | 693 |
| 267 | U5P749 | Cas9__U5P749__prot | 694 |
| 268 | K6QJ37 | Cas9__K6QJ37__prot | 695 |
| 269 | D4KTZ0 | Cas9__D4KTZ0__prot | 696 |
| 270 | U1GXL8 | Cas9__U1GXL8__prot | 697 |
| 271 | E8KVY4 | Cas9__E8KVY4__prot | 698 |
| 272 | A0A173V977 | Cas9__A0A173V977__prot | 699 |
| 273 | W3XZF8 | Cas9__W3XZF8__prot | 700 |
| 274 | A0A0X8G6A4 | Cas9__A0A0X8G6A4__prot | 701 |
| 275 | A0A139RFX7 | Cas9__A0A139RFX7__prot | 702 |
| 276 | A0A0R1M5J7 | Cas9__A0A0R1M5J7__prot | 703 |
| 277 | A0A0U3F8P4 | Cas9__A0A0U3F8P4__prot | 704 |
| 278 | B1SGF4 | Cas9__B1SGF4__prot | 705 |
| 279 | A0A0U3EY47 | Cas9__A0A0U3EY47__prot | 706 |
| 280 | A0A176T602 | Cas9__A0A176T602__prot | 707 |
| 281 | A0A1C3SQ53 | Cas9__A0A1C3SQ53__prot | 708 |
| 282 | F5WVI4 | Cas9__F5WVI4__prot | 709 |
| 283 | H2A7K0 | Cas9__H2A7K0__prot | 710 |
| 284 | A0A091BWC6 | Cas9__A0A091BWC6__prot | 711 |
| 285 | F5X275 | Cas9__F5X275__prot | 712 |
| 286 | A0A081JGI6 | Cas9__A0A081JGI6__prot | 713 |
| 287 | B9M9X8 | Cas9__B9M9X8__prot | 714 |
| 288 | A0A1D2U437 | Cas9__A0A1D2U437__prot | 715 |
| 289 | E6WZS9 | Cas9__E6WZS9__prot | 716 |
| 290 | S0J9K5 | Cas9__S0J9K5__prot | 717 |
| 291 | A0A0R1J9U0 | Cas9__A0A0R1J9U0__prot | 718 |
| 292 | X8KGX3 | Cas9__X8KGX3__prot | 719 |
| 293 | A0A081R6F9 | Cas9__A0A081R6F9__prot | 720 |
| 294 | A0A139QZ91 | Cas9__A0A139QZ91__prot | 721 |
| 295 | S1RM25 | Cas9__S1RM25__prot | 722 |
| 296 | E0PQK3 | Cas9__E0PQK3__prot | 723 |
| 297 | I0QHG7 | Cas9__I0QHG7__prot | 724 |
| 298 | A0A0R1XK13 | Cas9__A0A0R1XK13__prot | 725 |
| 299 | A0A1E9DYC7 | Cas9__A0A1E9DYC7__prot | 726 |
| 300 | A0A139NS17 | Cas9__A0A139NS17__prot | 727 |
| 301 | A8AY02 | Cas9__A8AY02__prot | 728 |
| 302 | E9DN79 | Cas9__E9DN79__prot | 729 |
| 303 | A0A125S8J4 | Cas9__A0A125S8J4__prot | 730 |
| 304 | K8Z8F3 | Cas9__K8Z8F3__prot | 731 |
| 305 | C7G697 | Cas9__C7G697__prot | 732 |
| 306 | A0A0F2E4R3 | Cas9__A0A0F2E4R3__prot | 733 |
| 307 | I2NMF2 | Cas9__I2NMF2__prot | 734 |
| 308 | A0A173VVZ1 | Cas9__A0A173VVZ1__prot | 735 |
| 309 | A0A1F0FMT7 | Cas9__A0A1F0FMT7__prot | 736 |
| 310 | K1LQN8 | Cas9__K1LQN8__prot | 737 |
| 311 | A0A125S8K1 | Cas9__A0A125S8K1__prot | 738 |
| 312 | A0A125S8K3 | Cas9__A0A125S8K3__prot | 739 |
| 313 | H8MA21 | Cas9__H8MA21__prot | 740 |
| 314 | W0SDH6 | Cas9__W0SDH6__prot | 741 |
| 315 | J9E534 | Cas9__J9E534__prot | 742 |
| 316 | A0A0V0PNI8 | Cas9__A0A0V0PNI8__prot | 743 |
| 317 | A0A171J711 | Cas9__A0A171J711__prot | 744 |
| 318 | Q1WVK1 | Cas9__Q1WVK1__prot | 745 |
| 319 | C0FXH5 | Cas9__C0FXH5__prot | 746 |
| 320 | K0XCK7 | Cas9__K0XCK7__prot | 747 |
| 321 | A0A125S8J8 | Cas9__A0A125S8J8__prot | 748 |
| 322 | A0A060RE66 | Cas9__A0A060RE66__prot | 749 |
| 323 | Q1QGC9 | Cas9__Q1QGC9__prot | 750 |
| 324 | D3NT09 | Cas9__D3NT09__prot | 751 |
| 325 | A0A0R1MEF5 | Cas9__A0A0R1MEF5__prot | 752 |
| 326 | A0A0R2CKA0 | Cas9__A0A0R2CKA0__prot | 753 |
| 327 | V4Q7N5 | Cas9__V4Q7N5__prot | 754 |
| 328 | Q2RX87 | Cas9__Q2RX87__prot | 755 |
| 329 | A0A0R2FKF9 | Cas9__A0A0R2FKF9__prot | 756 |
| 330 | R7BDB6 | Cas9__R7BDB6__prot | 757 |
| 331 | A0A1C9ZUE2 | Cas9__A0A1C9ZUE2__prot | 758 |
| 332 | S2WQ18 | Cas9__S2WQ18__prot | 759 |
| 333 | A0A1C9ZTA0 | Cas9__A0A1C9ZTA0__prot | 760 |
| 334 | F0RSV0 | Cas9__F0RSV0__prot | 761 |
| 335 | A0A0N0IXQ9 | Cas9__A0A0N0IXQ9__prot | 762 |
| 336 | A0A0R1X611 | Cas9__A0A0R1X611__prot | 763 |
| 337 | B2KB46 | Cas9__B2KB46__prot | 764 |
| 338 | U2KF13 | Cas9__U2KF13__prot | 765 |

TABLE 2-continued

Cas9 proteins of the invention

| Row | Column A<br>Protein Acc. No. | Protein (Cas9/Cpf1) | Column B<br>SEQ ID NO |
|---|---|---|---|
| 339 | D5ESN1 | Cas9__D5ESN1__prot | 766 |
| 340 | R7HI23 | Cas9__R7HI23__prot | 767 |
| 341 | I9J7D5 | Cas9__I9J7D5__prot | 768 |
| 342 | A0A0B0BZE8 | Cas9__A0A0B0BZE8__prot | 769 |
| 343 | R5W806 | Cas9__R5W806__prot | 770 |
| 344 | G6B158 | Cas9__G6B158__prot | 771 |
| 345 | U2IU08 | Cas9__U2IU08__prot | 772 |
| 346 | A0A096AT21 | Cas9__A0A096AT21__prot | 773 |
| 347 | R6ZCR1 | Cas9__R6ZCR1__prot | 774 |
| 348 | D1W6R4 | Cas9__D1W6R4__prot | 775 |
| 349 | D1VXP4 | Cas9__D1VXP4__prot | 776 |
| 350 | U7USL1 | Cas9__U7USL1__prot | 777 |
| 351 | E2N8V1 | Cas9__E2N8V1__prot | 778 |
| 352 | R6D2P4 | Cas9__R6D2P4__prot | 779 |
| 353 | A0A134BD56 | Cas9__A0A134BD56__prot | 780 |
| 354 | A0A099BT78 | Cas9__A0A099BT78__prot | 781 |
| 355 | R7CVK2 | Cas9__R7CVK2__prot | 782 |
| 356 | D2EJF1 | Cas9__D2EJF1__prot | 783 |
| 357 | A0A069QG82 | Cas9__A0A069QG82__prot | 784 |
| 358 | R5LWG1 | Cas9__R5LWG1__prot | 785 |
| 359 | C9LGP5 | Cas9__C9LGP5__prot | 786 |
| 360 | Q6KIQ7 | Cas9__Q6KIQ7__prot | 787 |
| 361 | A0A180F6C8 | Cas9__A0A180F6C8__prot | 788 |
| 362 | C0WRP7 | Cas9__C0WRP7__prot | 789 |
| 363 | A0A174NKB5 | Cas9__A0A174NKB5__prot | 790 |
| 364 | U2Y346 | Cas9__U2Y346__prot | 791 |
| 365 | A0A125S8I5 | Cas9__A0A125S8I5__prot | 792 |
| 366 | R7CG17 | Cas9__R7CG17__prot | 793 |
| 367 | F3A050 | Cas9__F3A050__prot | 794 |
| 368 | D1AUW6 | Cas9__D1AUW6__prot | 795 |
| 369 | A0A0X8KN88 | Cas9__A0A0X8KN88__prot | 796 |
| 370 | A0A0D5BKQ5 | Cas9__A0A0D5BKQ5__prot | 797 |
| 371 | A0A0N1DVV7 | Cas9__A0A0N1DVV7__prot | 798 |
| 372 | A0A085Z0I3 | Cas9__A0A085Z0I3__prot | 799 |
| 373 | J3TRJ9 | Cas9__J3TRJ9__prot | 800 |
| 374 | A0A0F6CLF2 | Cas9__A0A0F6CLF2__prot | 801 |
| 375 | A0A199XSD8 | Cas9__A0A199XSD8__prot | 802 |
| 376 | A0A0B8YC59 | Cas9__A0A0B8YC59__prot | 803 |
| 377 | K2M2X7 | Cas9__K2M2X7__prot | 804 |
| 378 | A0A1B9Y472 | Cas9__A0A1B9Y472__prot | 805 |
| 379 | A0A0Q4DTQ9 | Cas9__A0A0Q4DTQ9__prot | 806 |
| 380 | S4EM46 | Cas9__S4EM46__prot | 807 |
| 381 | A0A1D2JYF3 | Cas9__A0A1D2JYF3__prot | 808 |
| 382 | A0A0R2FVI8 | Cas9__A0A0R2FVI8__prot | 809 |
| 383 | A0A174LFF7 | Cas9__A0A174LFF7__prot | 810 |
| 384 | A0A173SPI3 | Cas9__A0A173SPI3__prot | 811 |
| 385 | D0DRL9 | Cas9__D0DRL9__prot | 812 |
| 386 | A0A175A1Y1 | Cas9__A0A175A1Y1__prot | 813 |
| 387 | A0A062XBE5 | Cas9__A0A062XBE5__prot | 814 |
| 388 | A0A0K8MIK7 | Cas9__A0A0K8MIK7__prot | 815 |
| 389 | A0A0R1TV35 | Cas9__A0A0R1TV35__prot | 816 |
| 390 | A0A125S8J7 | Cas9__A0A125S8J7__prot | 817 |
| 391 | A0A0R1ZP43 | Cas9__A0A0R1ZP43__prot | 818 |
| 392 | W4T7U3 | Cas9__W4T7U3__prot | 819 |
| 393 | A0A0J5P9G6 | Cas9__A0A0J5P9G6__prot | 820 |
| 394 | A0A0R2CL57 | Cas9__A0A0R2CL57__prot | 821 |
| 395 | R6U7U5 | Cas9__R6U7U5__prot | 822 |
| 396 | A0A0R2AFH9 | Cas9__A0A0R2AFH9__prot | 823 |
| 397 | E7MR72 | Cas9__E7MR72__prot | 824 |
| 398 | A0A1C0YPC7 | Cas9__A0A1C0YPC7__prot | 825 |
| 399 | A0A179EQS1 | Cas9__A0A179EQS1__prot | 826 |
| 400 | W9EE99 | Cas9__W9EE99__prot | 827 |
| 401 | A0A0R2BKJ5 | Cas9__A0A0R2BKJ5__prot | 828 |
| 402 | E6LI02 | Cas9__E6LI02__prot | 829 |
| 403 | V5XLV7 | Cas9__V5XLV7__prot | 830 |
| 404 | G2KVM6 | Cas9__G2KVM6__prot | 831 |
| 405 | A0A1C5TF27 | Cas9__A0A1C5TF27__prot | 832 |
| 406 | H3NFH0 | Cas9__H3NFH0__prot | 833 |
| 407 | A0A081BKX9 | Cas9__A0A081BKX9__prot | 834 |
| 408 | A0A1C7DHH3 | Cas9__A0A1C7DHH3__prot | 835 |
| 409 | R7GMQ9 | Cas9__R7GMQ9__prot | 836 |
| 410 | R6QHH1 | Cas9__R6QHH1__prot | 837 |
| 411 | A0A174HSW2 | Cas9__A0A174HSW2__prot | 838 |
| 412 | A0A0R2HIR8 | Cas9__A0A0R2HIR8__prot | 839 |
| 413 | A0A0H3GNI1 | Cas9__A0A0H3GNI1__prot | 840 |

TABLE 2-continued

Cas9 proteins of the invention

| Row | Column A Protein Acc. No. | Protein (Cas9/Cpf1) | Column B SEQ ID NO |
|---|---|---|---|
| 414 | A0A0F5ZHG0 | Cas9__A0A0F5ZHG0__prot | 841 |
| 415 | A0A0H3J2A7 | Cas9__A0A0H3J2A7__prot | 842 |
| 416 | A0A166RWM5 | Cas9__A0A166RWM5__prot | 843 |
| 417 | A0A1E6FAD7 | Cas9__A0A1E6FAD7__prot | 844 |
| 418 | A0A1E8EQS5 | Cas9__A0A1E8EQS5__prot | 845 |
| 419 | A0A1E7DWS8 | Cas9__A0A1E7DWS8__prot | 846 |
| 420 | A0A1E5ZAU0 | Cas9__A0A1E5ZAU0__prot | 847 |
| 421 | A0A1E8EI75 | Cas9__A0A1E8EI75__prot | 848 |
| 422 | R3WHR8 | Cas9__R3WHR8__prot | 849 |
| 423 | A0A097B8A9 | Cas9__A0A097B8A9__prot | 850 |
| 424 | A0A095XEU7 | Cas9__A0A095XEU7__prot | 851 |
| 425 | A0A0R1RFJ4 | Cas9__A0A0R1RFJ4__prot | 852 |
| 426 | A0A160NBB3 | Cas9__A0A160NBB3__prot | 853 |
| 427 | I6T669 | Cas9__I6T669__prot | 854 |
| 428 | H1GG18 | Cas9__H1GG18__prot | 855 |
| 429 | A0A017H668 | Cas9__A0A017H668__prot | 856 |
| 430 | A0A121IZ21 | Cas9__A0A121IZ21__prot | 857 |
| 431 | A0A1B4XLG6 | Cas9__A0A1B4XLG6__prot | 858 |
| 432 | U6S081 | Cas9__U6S081__prot | 859 |
| 433 | E6GPD8 | Cas9__E6GPD8__prot | 860 |
| 434 | H3NQF8 | Cas9__H3NQF8__prot | 861 |
| 435 | D4J3S7 | Cas9__D4J3S7__prot | 862 |
| 436 | G5JVJ9 | Cas9__G5JVJ9__prot | 863 |
| 437 | R9MHT9 | Cas9__R9MHT9__prot | 864 |
| 438 | R2SDC4 | Cas9__R2SDC4__prot | 865 |
| 439 | H7FYD8 | Cas9__H7FYD8__prot | 866 |
| 440 | A0A1D2JQJ5 | Cas9__A0A1D2JQJ5__prot | 867 |
| 441 | A0A1D2LU44 | Cas9__A0A1D2LU44__prot | 868 |
| 442 | C9BHR2 | Cas9__C9BHR2__prot | 869 |
| 443 | L2LBP5 | Cas9__L2LBP5__prot | 870 |
| 444 | R6ZAM8 | Cas9__R6ZAM8__prot | 871 |
| 445 | A6BJV4 | Cas9__A6BJV4__prot | 872 |
| 446 | A0A174GDD3 | Cas9__A0A174GDD3__prot | 873 |
| 447 | C9BWE2 | Cas9__C9BWE2__prot | 874 |
| 448 | A0A173UVP4 | Cas9__A0A173UVP4__prot | 875 |
| 449 | R5BQB0 | Cas9__R5BQB0__prot | 876 |
| 450 | D7N6R3 | Cas9__D7N6R3__prot | 877 |
| 451 | A0A1C5P2V8 | Cas9__A0A1C5P2V8__prot | 878 |
| 452 | B5CL59 | Cas9__B5CL59__prot | 879 |
| 453 | A0A0R2JSC5 | Cas9__A0A0R2JSC5__prot | 880 |
| 454 | A0A1C6BK34 | Cas9__A0A1C6BK34__prot | 881 |
| 455 | R7KBA0 | Cas9__R7KBA0__prot | 882 |
| 456 | A0A0R2HM97 | Cas9__A0A0R2HM97__prot | 883 |
| 457 | U7PCQ1 | Cas9__U7PCQ1__prot | 884 |
| 458 | R5V4T4 | Cas9__R5V4T4__prot | 885 |
| 459 | A0A133QT10 | Cas9__A0A133QT10__prot | 886 |
| 460 | A0A0E2EP65 | Cas9__A0A0E2EP65__prot | 887 |
| 461 | R5MT23 | Cas9__R5MT23__prot | 888 |
| 462 | A0A0R2DR00 | Cas9__A0A0R2DR00__prot | 889 |
| 463 | R5N3I1 | Cas9__R5N3I1__prot | 890 |
| 464 | I0SF74 | Cas9__I0SF74__prot | 891 |
| 465 | E6J3R0 | Cas9__E6J3R0__prot | 892 |
| 466 | U2YFI6 | Cas9__U2YFI6__prot | 893 |
| 467 | A0A0R2DIR3 | Cas9__A0A0R2DIR3__prot | 894 |
| 468 | U2U1P0 | Cas9__U2U1P0__prot | 895 |
| 469 | A0A134CKK1 | Cas9__A0A134CKK1__prot | 896 |
| 470 | A0A0R2N0I6 | Cas9__A0A0R2N0I6__prot | 897 |
| 471 | A0A125S8I2 | Cas9__A0A125S8I2__prot | 898 |
| 472 | A0A0R1ZCI7 | Cas9__A0A0R1ZCI7__prot | 899 |
| 473 | A0A0R1SCA3 | Cas9__A0A0R1SCA3__prot | 900 |
| 474 | D9PRA6 | Cas9__D9PRA6__prot | 901 |
| 475 | A0A0D0ZAW2 | Cas9__A0A0D0ZAW2__prot | 902 |
| 476 | F9N0W8 | Cas9__F9N0W8__prot | 903 |
| 477 | B0RZQ7 | Cas9__B0RZQ7__prot | 904 |
| 478 | R6XMN7 | Cas9__R6XMN7__prot | 905 |
| 479 | U2SSY7 | Cas9__U2SSY7__prot | 906 |
| 480 | S4NUM0 | Cas9__S4NUM0__prot | 907 |
| 481 | A0A072ETA7 | Cas9__A0A072ETA7__prot | 908 |
| 482 | R5RU71 | Cas9__R5RU71__prot | 909 |
| 483 | A0A174FD97 | Cas9__A0A174FD97__prot | 910 |
| 484 | A0A0A8K7X7 | Cas9__A0A0A8K7X7__prot | 911 |
| 485 | R5Z6B4 | Cas9__R5Z6B4__prot | 912 |
| 486 | S1NSG8 | Cas9__S1NSG8__prot | 913 |
| 487 | A0A1D8P523 | Cas9__A0A1D8P523__prot | 914 |
| 488 | A0A1C6IPF7 | Cas9__A0A1C6IPF7__prot | 915 |

TABLE 2-continued

Cas9 proteins of the invention

| Row | Column A Protein Acc. No. | Protein (Cas9/Cpf1) | Column B SEQ ID NO |
|---|---|---|---|
| 489 | A0A0R1MNC7 | Cas9__A0A0R1MNC7__prot | 916 |
| 490 | A0A132HQM8 | Cas9__A0A132HQM8__prot | 917 |
| 491 | A0A0M9VGT5 | Cas9__A0A0M9VGT5__prot | 918 |
| 492 | F9MP31 | Cas9__F9MP31__prot | 919 |
| 493 | A0A0R1V7X0 | Cas9__A0A0R1V7X0__prot | 920 |
| 494 | A0A0X7BAB3 | Cas9__A0A0X7BAB3__prot | 921 |
| 495 | R7K435 | Cas9__R7K435__prot | 922 |
| 496 | I3Z8Z5 | Cas9__I3Z8Z5__prot | 923 |
| 497 | A0A173YKH0 | Cas9__A0A173YKH0__prot | 924 |
| 498 | A0A174PI34 | Cas9__A0A174PI34__prot | 925 |
| 499 | A0A1C6E673 | Cas9__A0A1C6E673__prot | 926 |
| 500 | R5YGP2 | Cas9__R5YGP2__prot | 927 |
| 501 | A0A076P3F6 | Cas9__A0A076P3F6__prot | 928 |
| 502 | A0A176Y372 | Cas9__A0A176Y372__prot | 929 |
| 503 | D3I574 | Cas9__D3I574__prot | 930 |
| 504 | S2D876 | Cas9__S2D876__prot | 931 |
| 505 | A0A0R1F6R4 | Cas9__A0A0R1F6R4__prot | 932 |
| 506 | J9YH95 | Cas9__J9YH95__prot | 933 |
| 507 | R5SXF4 | Cas9__R5SXF4__prot | 934 |
| 508 | R6P3Z6 | Cas9__R6P3Z6__prot | 935 |
| 509 | A0A0R1IS26 | Cas9__A0A0R1IS26__prot | 936 |
| 510 | A0A0H4LAX2 | Cas9__A0A0H4LAX2__prot | 937 |
| 511 | A0A0K2LF21 | Cas9__A0A0K2LF21__prot | 938 |
| 512 | A0A0R1QGB6 | Cas9__A0A0R1QGB6__prot | 939 |
| 513 | A0A143W8R3 | Cas9__A0A143W8R3__prot | 940 |
| 514 | M4KKI8 | Cas9__M4KKI8__prot | 941 |
| 515 | A0A0R1FUZ5 | Cas9__A0A0R1FUZ5__prot | 942 |
| 516 | F6ITQ2 | Cas9__F6ITQ2__prot | 943 |
| 517 | A0A1E3KQ44 | Cas9__A0A1E3KQ44__prot | 944 |
| 518 | A0A173WIE2 | Cas9__A0A173WIE2__prot | 945 |
| 519 | G4Q6A5 | Cas9__G4Q6A5__prot | 946 |
| 520 | A0A0K1MWW2 | Cas9__A0A0K1MWW2__prot | 947 |
| 521 | A0A0H0YP06 | Cas9__A0A0H0YP06__prot | 948 |
| 522 | A0A0C9QP69 | Cas9__A0A0C9QP69__prot | 949 |
| 523 | A0A0E4H4H8 | Cas9__A0A0E4H4H8__prot | 950 |
| 524 | C2CKI6 | Cas9__C2CKI6__prot | 951 |
| 525 | A0A0M2FYH7 | Cas9__A0A0M2FYH7__prot | 952 |
| 526 | R6TGN6 | Cas9__R6TGN6__prot | 953 |
| 527 | I9L4B5 | Cas9__I9L4B5__prot | 954 |
| 528 | A0A133KEN0 | Cas9__A0A133KEN0__prot | 955 |
| 529 | A0A139NKI7 | Cas9__A0A139NKI7__prot | 956 |
| 530 | T5JDL4 | Cas9__T5JDL4__prot | 957 |
| 531 | C5F8S2 | Cas9__C5F8S2__prot | 958 |
| 532 | S4ZP66 | Cas9__S4ZP66__prot | 959 |
| 533 | S2LEI5 | Cas9__S2LEI5__prot | 960 |
| 534 | A0A0R1UKG9 | Cas9__A0A0R1UKG9__prot | 961 |
| 535 | A0A174P7Q9 | Cas9__A0A174P7Q9__prot | 962 |
| 536 | K6R5Z8 | Cas9__K6R5Z8__prot | 963 |
| 537 | A0A0R1S2S1 | Cas9__A0A0R1S2S1__prot | 964 |
| 538 | A0A0R1MEL8 | Cas9__A0A0R1MEL8__prot | 965 |
| 539 | A0A0C9Q7U6 | Cas9__A0A0C9Q7U6__prot | 966 |
| 540 | A0A179YJ40 | Cas9__A0A179YJ40__prot | 967 |
| 541 | C7TEQ6 | Cas9__C7TEQ6__prot | 968 |
| 542 | E0NI75 | Cas9__E0NI75__prot | 969 |
| 543 | A0A133ZK65 | Cas9__A0A133ZK65__prot | 970 |
| 544 | A0A0R1RRH5 | Cas9__A0A0R1RRH5__prot | 971 |
| 545 | E0NJ84 | Cas9__E0NJ84__prot | 972 |
| 546 | A0A0R2HZC9 | Cas9__A0A0R2HZC9__prot | 973 |
| 547 | A0A180AER3 | Cas9__A0A180AER3__prot | 974 |
| 548 | D6GRK4 | Cas9__D6GRK4__prot | 975 |
| 549 | A0A1B3WEM9 | Cas9__A0A1B3WEM9__prot | 976 |
| 550 | A0A116L128 | Cas9__A0A116L128__prot | 977 |
| 551 | A0A127TRM8 | Cas9__A0A127TRM8__prot | 978 |
| 552 | A0A0R1W1T1 | Cas9__A0A0R1W1T1__prot | 979 |
| 553 | A0A1A5VIM0 | Cas9__A0A1A5VIM0__prot | 980 |
| 554 | K6RXS8 | Cas9__K6RXS8__prot | 981 |
| 555 | X0QNI0 | Cas9__X0QNI0__prot | 982 |
| 556 | R5WWQ0 | Cas9__R5WWQ0__prot | 983 |
| 557 | C7XMU0 | Cas9__C7XMU0__prot | 984 |
| 558 | D6LEV9 | Cas9__D6LEV9__prot | 985 |
| 559 | A0A128ECZ8 | Cas9__A0A128ECZ8__prot | 986 |
| 560 | A0A133NAH6 | Cas9__A0A133NAH6__prot | 987 |
| 561 | A0A0X3Y1U5 | Cas9__A0A0X3Y1U5__prot | 988 |
| 562 | A0A116M370 | Cas9__A0A116M370__prot | 989 |
| 563 | A0A116KLL2 | Cas9__A0A116KLL2__prot | 990 |

TABLE 2-continued

Cas9 proteins of the invention

| Row | Column A<br>Protein Acc. No. | Protein (Cas9/Cpf1) | Column B<br>SEQ ID NO |
|---|---|---|---|
| 564 | A0A1B2IXP8 | Cas9__A0A1B2IXP8__prot | 991 |
| 565 | A0A0R1LCE0 | Cas9__A0A0R1LCE0__prot | 992 |
| 566 | A0A0R1WWN2 | Cas9__A0A0R1WWN2__prot | 993 |
| 567 | A0A0C6FZC2 | Cas9__A0A0C6FZC2__prot | 994 |
| 568 | A0A127X7N0 | Cas9__A0A127X7N0__prot | 995 |
| 569 | A0A1B4Z6K5 | Cas9__A0A1B4Z6K5__prot | 996 |
| 570 | R9LW52 | Cas9__R9LW52__prot | 997 |
| 571 | A0A0B2XHU2 | Cas9__A0A0B2XHU2__prot | 998 |
| 572 | A0A1B2A6P4 | Cas9__A0A1B2A6P4__prot | 999 |
| 573 | A0A0P6SHS4 | Cas9__A0A0P6SHS4__prot | 1000 |
| 574 | A0A0H3BZZ0 | Cas9__A0A0H3BZZ0__prot | 1001 |
| 575 | A0A0R1TGJ3 | Cas9__A0A0R1TGJ3__prot | 1002 |
| 576 | Q1JLZ6 | Cas9__Q1JLZ6__prot | 1003 |
| 577 | Q48TU5 | Cas9__Q48TU5__prot | 1004 |
| 578 | G6CGE4 | Cas9__G6CGE4__prot | 1005 |
| 579 | Q1JH43 | Cas9__Q1JH43__prot | 1006 |
| 580 | R5C8N0 | Cas9__R5C8N0__prot | 1007 |
| 581 | A0A0R1SN52 | Cas9__A0A0R1SN52__prot | 1008 |
| 582 | A0A0R2DGS6 | Cas9__A0A0R2DGS6__prot | 1009 |
| 583 | A0A0R1SDU2 | Cas9__A0A0R1SDU2__prot | 1010 |
| 584 | A0A0D0YUU5 | Cas9__A0A0D0YUU5__prot | 1011 |
| 585 | S9AZZ0 | Cas9__S9AZZ0__prot | 1012 |
| 586 | A0A0E1XG84 | Cas9__A0A0E1XG84__prot | 1013 |
| 587 | R6ET93 | Cas9__R6ET93__prot | 1014 |
| 588 | S9BFF6 | Cas9__S9BFF6__prot | 1015 |
| 589 | A0A1B3PSQ7 | Cas9__A0A1B3PSQ7__prot | 1016 |
| 590 | A0A137PP63 | Cas9__A0A137PP63__prot | 1017 |
| 591 | S9KSN8 | Cas9__S9KSN8__prot | 1018 |
| 592 | Q8E042 | Cas9__Q8E042__prot | 1019 |
| 593 | S8HGI0 | Cas9__S8HGI0__prot | 1020 |
| 594 | S8H4C8 | Cas9__S8H4C8__prot | 1021 |
| 595 | F0FD37 | Cas9__F0FD37__prot | 1022 |
| 596 | J3JPT0 | Cas9__J3JPT0__prot | 1023 |
| 597 | F8Y040 | Cas9__F8Y040__prot | 1024 |
| 598 | A0A0R2JE56 | Cas9__A0A0R2JE56__prot | 1025 |
| 599 | A0A1A9E0X4 | Cas9__A0A1A9E0X4__prot | 1026 |
| 600 | A0A0E1EMN2 | Cas9__A0A0E1EMN2__prot | 1027 |
| 601 | A0A1C0BC24 | Cas9__A0A1C0BC24__prot | 1028 |
| 602 | A0A1E2WAR5 | Cas9__A0A1E2WAR5__prot | 1029 |
| 603 | S8FJS0 | Cas9__S8FJS0__prot | 1030 |
| 604 | F4FTI2 | Cas9__F4FTI2__prot | 1031 |
| 605 | K4Q9P5 | Cas9__K4Q9P5__prot | 1032 |
| 606 | M4YX12 | Cas9__M4YX12__prot | 1033 |
| 607 | F9HIG7 | Cas9__F9HIG7__prot | 1034 |
| 608 | F5WVJ4 | Cas9__F5WVJ4__prot | 1035 |
| 609 | D6E761 | Cas9__D6E761__prot | 1036 |
| 610 | I0Q2W2 | Cas9__I0Q2W2__prot | 1037 |
| 611 | C5WH61 | Cas9__C5WH61__prot | 1038 |
| 612 | A0A1C2CVQ9 | Cas9__A0A1C2CVQ9__prot | 1039 |
| 613 | K8MQ90 | Cas9__K8MQ90__prot | 1040 |
| 614 | A0A0R1JG51 | Cas9__A0A0R1JG51__prot | 1041 |
| 615 | J9W3C2 | Cas9__J9W3C2__prot | 1042 |
| 616 | Q1J6W2 | Cas9__Q1J6W2__prot | 1043 |
| 617 | R5GJ26 | Cas9__R5GJ26__prot | 1044 |
| 618 | A0A172Q7S3 | Cas9__A0A172Q7S3__prot | 1045 |
| 619 | A0A060RIR3 | Cas9__A0A060RIR3__prot | 1046 |
| 620 | A0A1C5U497 | Cas9__A0A1C5U497__prot | 1047 |
| 621 | S5R5C8 | Cas9__S5R5C8__prot | 1048 |
| 622 | A0A0W7V6X6 | Cas9__A0A0W7V6X6__prot | 1049 |
| 623 | A0A1C5S579 | Cas9__A0A1C5S579__prot | 1050 |
| 624 | A0A125S8J0 | Cas9__A0A125S8J0__prot | 1051 |
| 625 | E0PEL3 | Cas9__E0PEL3__prot | 1052 |
| 626 | J4K985 | Cas9__J4K985__prot | 1053 |
| 627 | U2PI18 | Cas9__U2PI18__prot | 1054 |
| 628 | G5KAN2 | Cas9__G5KAN2__prot | 1055 |
| 629 | Q7P7J1 | Cas9__Q7P7J1__prot | 1056 |
| 630 | A0A0F2D9H7 | Cas9__A0A0F2D9H7__prot | 1057 |
| 631 | A0A1D7ZZ65 | Cas9__A0A1D7ZZ65__prot | 1058 |
| 632 | E7FPD8 | Cas9__E7FPD8__prot | 1059 |
| 633 | A0A176TM67 | Cas9__A0A176TM67__prot | 1060 |
| 634 | G6AFY6 | Cas9__G6AFY6__prot | 1061 |
| 635 | E9FPR9 | Cas9__E9FPR9__prot | 1062 |
| 636 | I7QXF2 | Cas9__I7QXF2__prot | 1063 |
| 637 | I0TCL1 | Cas9__I0TCL1__prot | 1064 |
| 638 | A0A173R3H4 | Cas9__A0A173R3H4__prot | 1065 |

TABLE 2-continued

Cas9 proteins of the invention

| Row | Column A<br>Protein Acc. No. | Protein (Cas9/Cpf1) | Column B<br>SEQ ID NO |
|---|---|---|---|
| 639 | A0A178KKP5 | Cas9__A0A178KKP5__prot | 1066 |
| 640 | H6PBR9 | Cas9__H6PBR9__prot | 1067 |
| 641 | F4AF10 | Cas9__F4AF10__prot | 1068 |
| 642 | A0A134C7A8 | Cas9__A0A134C7A8__prot | 1069 |
| 643 | A0A0R1SG79 | Cas9__A0A0R1SG79__prot | 1070 |
| 644 | A0A0F2DWP8 | Cas9__A0A0F2DWP8__prot | 1071 |
| 645 | A0A0R1K630 | Cas9__A0A0R1K630__prot | 1072 |
| 646 | A0A135YMA6 | Cas9__A0A135YMA6__prot | 1073 |
| 647 | F0I6Z8 | Cas9__F0I6Z8__prot | 1074 |
| 648 | E9FJ16 | Cas9__E9FJ16__prot | 1075 |
| 649 | C2D302 | Cas9__C2D302__prot | 1076 |
| 650 | Q8E5R9 | Cas9__Q8E5R9__prot | 1077 |
| 651 | E8JP81 | Cas9__E8JP81__prot | 1078 |
| 652 | A0A0R1RHH9 | Cas9__A0A0R1RHH9__prot | 1079 |
| 653 | A0A0F3FWK9 | Cas9__A0A0F3FWK9__prot | 1080 |
| 654 | A0A0R2I8Q5 | Cas9__A0A0R2I8Q5__prot | 1081 |
| 655 | A0A150NPH1 | Cas9__A0A150NPH1__prot | 1082 |
| 656 | E7S4M3 | Cas9__E7S4M3__prot | 1083 |
| 657 | A0A143ASS0 | Cas9__A0A143ASS0__prot | 1084 |
| 658 | A0A0R2HDR9 | Cas9__A0A0R2HDR9__prot | 1085 |
| 659 | A0A0B2JE32 | Cas9__A0A0B2JE32__prot | 1086 |
| 660 | A0A0R2KUQ3 | Cas9__A0A0R2KUQ3__prot | 1087 |
| 661 | A0A0W7V0H0 | Cas9__A0A0W7V0H0__prot | 1088 |
| 662 | R6TGA0 | Cas9__R6TGA0__prot | 1089 |
| 663 | A0A0H5B4T2 | Cas9__A0A0H5B4T2__prot | 1090 |
| 664 | U2J559 | Cas9__U2J559__prot | 1091 |
| 665 | A0A075SSB9 | Cas9__A0A075SSB9__prot | 1092 |
| 666 | A0A096B7Z5 | Cas9__A0A096B7Z5__prot | 1093 |
| 667 | L9PS87 | Cas9__L9PS87__prot | 1094 |
| 668 | A0A134D9V8 | Cas9__A0A134D9V8__prot | 1095 |
| 669 | F7UWL3 | Cas9__F7UWL3__prot | 1096 |
| 670 | G7SP82 | Cas9__G7SP82__prot | 1097 |
| 671 | A0A0R2E213 | Cas9__A0A0R2E213__prot | 1098 |
| 672 | R7I2K1 | Cas9__R7I2K1__prot | 1099 |
| 673 | C0WXA2 | Cas9__C0WXA2__prot | 1100 |
| 674 | A0A0Z8GCN2 | Cas9__A0A0Z8GCN2__prot | 1101 |
| 675 | R5GUN8 | Cas9__R5GUN8__prot | 1102 |
| 676 | A0A116RA22 | Cas9__A0A116RA22__prot | 1103 |
| 677 | A0A0Z8JWB5 | Cas9__A0A0Z8JWB5__prot | 1104 |
| 678 | A0A116KAQ7 | Cas9__A0A116KAQ7__prot | 1105 |
| 679 | G0M2G7 | Cas9__G0M2G7__prot | 1106 |
| 680 | A0A1C5P5Q5 | Cas9__A0A1C5P5Q5__prot | 1107 |
| 681 | A0A0H1TNR9 | Cas9__A0A0H1TNR9__prot | 1108 |
| 682 | F2NB82 | Cas9__F2NB82__prot | 1109 |
| 683 | J7TMY5 | Cas9__J7TMY5__prot | 1110 |
| 684 | A0A125S8I1 | Cas9__A0A125S8I1__prot | 1111 |
| 685 | A0A078RYQ2 | Cas9__A0A078RYQ2__prot | 1112 |
| 686 | A0A0F3H9Z9 | Cas9__A0A0F3H9Z9__prot | 1113 |
| 687 | E5V117 | Cas9__E5V117__prot | 1114 |
| 688 | J4TM44 | Cas9__J4TM44__prot | 1115 |
| 689 | I7L6U4 | Cas9__I7L6U4__prot | 1116 |
| 690 | R5J5B2 | Cas9__R5J5B2__prot | 1117 |
| 691 | A0A1B2ULM2 | Cas9__A0A1B2ULM2__prot | 1118 |
| 692 | A0A0P6UDU2 | Cas9__A0A0P6UDU2__prot | 1119 |
| 693 | V8LSG7 | Cas9__V8LSG7__prot | 1120 |
| 694 | D5BC98 | Cas9__D5BC98__prot | 1121 |
| 695 | K0MXA7 | Cas9__K0MXA7__prot | 1122 |
| 696 | G9WGU4 | Cas9__G9WGU4__prot | 1123 |
| 697 | A0A1C2D810 | Cas9__A0A1C2D810__prot | 1124 |
| 698 | A0A087BJ94 | Cas9__A0A087BJ94__prot | 1125 |
| 699 | A0A0R1S4R8 | Cas9__A0A0R1S4R8__prot | 1126 |
| 700 | E0QLT3 | Cas9__E0QLT3__prot | 1127 |
| 701 | C4VKS7 | Cas9__C4VKS7__prot | 1128 |
| 702 | A9DTN2 | Cas9__A9DTN2__prot | 1129 |
| 703 | K2PT21 | Cas9__K2PT21__prot | 1130 |
| 704 | E7RR33 | Cas9__E7RR33__prot | 1131 |
| 705 | A0A0N0CU60 | Cas9__A0A0N0CU60__prot | 1132 |
| 706 | A0A0P7LUX3 | Cas9__A0A0P7LUX3__prot | 1133 |
| 707 | R7D1C6 | Cas9__R7D1C6__prot | 1134 |
| 708 | V8BZU1 | Cas9__V8BZU1__prot | 1135 |
| 709 | A0A0F4LG72 | Cas9__A0A0F4LG72__prot | 1136 |
| 710 | J4KB57 | Cas9__J4KB57__prot | 1137 |
| 711 | W1U735 | Cas9__W1U735__prot | 1138 |
| 712 | A0A095ZV18 | Cas9__A0A095ZV18__prot | 1139 |
| 713 | R5BUB1 | Cas9__R5BUB1__prot | 1140 |

TABLE 2-continued

Cas9 proteins of the invention

| Row | Column A<br>Protein Acc. No. | Protein (Cas9/Cpf1) | Column B<br>SEQ ID NO |
|---|---|---|---|
| 714 | F2C4I5 | Cas9_F2C4I5_prot | 1141 |
| 715 | E1LI65 | Cas9_E1LI65_prot | 1142 |
| 716 | A0A0N0UTU1 | Cas9_A0A0N0UTU1_prot | 1143 |
| 717 | C5NZ04 | Cas9_C5NZ04_prot | 1144 |
| 718 | A0A081Q742 | Cas9_A0A081Q742_prot | 1145 |
| 719 | A0A0F2DF30 | Cas9_A0A0F2DF30_prot | 1146 |
| 720 | A0A0F4LMR6 | Cas9_A0A0F4LMR6_prot | 1147 |
| 721 | A0A0E2EBU7 | Cas9_A0A0E2EBU7_prot | 1148 |
| 722 | A0A0E2EGB1 | Cas9_A0A0E2EGB1_prot | 1149 |
| 723 | A0A0C3A2P0 | Cas9_A0A0C3A2P0_prot | 1150 |
| 724 | M2CG59 | Cas9_M2CG59_prot | 1151 |
| 725 | R5R3T7 | Cas9_R5R3T7_prot | 1152 |
| 726 | D6KPM9 | Cas9_D6KPM9_prot | 1153 |
| 727 | U2VD49 | Cas9_U2VD49_prot | 1154 |
| 728 | D6S374 | Cas9_D6S374_prot | 1155 |
| 729 | A0A0R2KGU9 | Cas9_A0A0R2KGU9_prot | 1156 |
| 730 | A0A0F6MNW4 | Cas9_A0A0F6MNW4_prot | 1157 |
| 731 | A0A0X3ARL2 | Cas9_A0A0X3ARL2_prot | 1158 |
| 732 | A0A088RCP8 | Cas9_A0A088RCP8_prot | 1159 |
| 733 | S3KPV3 | Cas9_S3KPV3_prot | 1160 |
| 734 | M2CIC2 | Cas9_M2CIC2_prot | 1161 |
| 735 | M2SLU3 | Cas9_M2SLU3_prot | 1162 |
| 736 | A0A0D4CLL6 | Cas9_A0A0D4CLL6_prot | 1163 |
| 737 | R6I3U9 | Cas9_R6I3U9_prot | 1164 |
| 738 | F5U0T2 | Cas9_F5U0T2_prot | 1165 |
| 739 | A0A0F4LIJ0 | Cas9_A0A0F4LIJ0_prot | 1166 |
| 740 | A0A0N0CQ86 | Cas9_A0A0N0CQ86_prot | 1167 |
| 741 | I3C2S4 | Cas9_I3C2S4_prot | 1168 |
| 742 | U2QKG2 | Cas9_U2QKG2_prot | 1169 |
| 743 | D1YP75 | Cas9_D1YP75_prot | 1170 |
| 744 | A0A091BLA4 | Cas9_A0A091BLA4_prot | 1171 |
| 745 | A0A100YPE0 | Cas9_A0A100YPE0_prot | 1172 |
| 746 | E1LBR5 | Cas9_E1LBR5_prot | 1173 |
| 747 | R5BD80 | Cas9_R5BD80_prot | 1174 |
| 748 | W3Y2C1 | Cas9_W3Y2C1_prot | 1175 |
| 749 | E1QW44 | Cas9_E1QW44_prot | 1176 |
| 750 | A0A134A1I6 | Cas9_A0A134A1I6_prot | 1177 |
| 751 | A0A0F4M7Y5 | Cas9_A0A0F4M7Y5_prot | 1178 |
| 752 | A0A133YSB7 | Cas9_A0A133YSB7_prot | 1179 |
| 753 | A0A089Y508 | Cas9_A0A089Y508_prot | 1180 |
| 754 | A0A162CL99 | Cas9_A0A162CL99_prot | 1181 |
| 755 | A0A133YDF1 | Cas9_A0A133YDF1_prot | 1182 |
| 756 | A0A133YY65 | Cas9_A0A133YY65_prot | 1183 |
| 757 | A0A0B4S2L0 | Cas9_A0A0B4S2L0_prot | 1184 |
| 758 | A0A0R2DLB6 | Cas9_A0A0R2DLB6_prot | 1185 |
| 759 | A0A0G3MB19 | Cas9_A0A0G3MB19_prot | 1186 |
| 760 | A0A0Q3K6A2 | Cas9_A0A0Q3K6A2_prot | 1187 |
| 761 | A0A134AG29 | Cas9_A0A134AG29_prot | 1188 |
| 762 | A0A0N1DXX4 | Cas9_A0A0N1DXX4_prot | 1189 |
| 763 | A0A1E4DZC0 | Cas9_A0A1E4DZC0_prot | 1190 |
| 764 | J9R1Q7 | Cas9_J9R1Q7_prot | 1191 |
| 765 | A0A1C4DJV4 | Cas9_A0A1C4DJV4_prot | 1192 |
| 766 | A0A077KK20 | Cas9_A0A077KK20_prot | 1193 |
| 767 | A0A085ZZC2 | Cas9_A0A085ZZC2_prot | 1194 |
| 768 | W1V0U5 | Cas9_W1V0U5_prot | 1195 |
| 769 | A0A0K9XVX7 | Cas9_A0A0K9XVX7_prot | 1196 |
| 770 | A0A1H5RY71 | Cas9_A0A1H5RY71_prot | 1197 |
| 771 | A0A0J7IGI6 | Cas9_A0A0J7IGI6_prot | 1198 |
| 772 | A0A086AYB7 | Cas9_A0A086AYB7_prot | 1199 |
| 773 | A0A125S8K4 | Cas9_A0A125S8K4_prot | 1200 |
| 774 | M3INT0 | Cas9_M3INT0_prot | 1201 |
| 775 | R5FLM1 | Cas9_R5FLM1_prot | 1202 |
| 776 | U5Q7L9 | Cas9_U5Q7L9_prot | 1203 |
| 777 | A0A1E3DW10 | Cas9_A0A1E3DW10_prot | 1204 |
| 778 | K0NQV3 | Cas9_K0NQV3_prot | 1205 |
| 779 | J2KJ07 | Cas9_J2KJ07_prot | 1206 |
| 780 | A0A0U5KB17 | Cas9_A0A0U5KB17_prot | 1207 |
| 781 | A0A0D6ZH65 | Cas9_A0A0D6ZH65_prot | 1208 |
| 782 | A0A139PB46 | Cas9_A0A139PB46_prot | 1209 |
| 783 | A0A139NVJ1 | Cas9_A0A139NVJ1_prot | 1210 |
| 784 | A0A139NSX3 | Cas9_A0A139NSX3_prot | 1211 |
| 785 | E0Q490 | Cas9_E0Q490_prot | 1212 |
| 786 | E3ELL7 | Cas9_E3ELL7_prot | 1213 |
| 787 | A0A061CF22 | Cas9_A0A061CF22_prot | 1214 |
| 788 | F3UXG6 | Cas9_F3UXG6_prot | 1215 |

TABLE 2-continued

Cas9 proteins of the invention

| Row | Column A<br>Protein Acc. No. | Protein (Cas9/Cpf1) | Column B<br>SEQ ID NO |
|---|---|---|---|
| 789 | A0A125S8K2 | Cas9__A0A125S8K2__prot | 1216 |
| 790 | A0A0B7IR20 | Cas9__A0A0B7IR20__prot | 1217 |
| 791 | A0A174J8H3 | Cas9__A0A174J8H3__prot | 1218 |
| 792 | D7IW96 | Cas9__D7IW96__prot | 1219 |
| 793 | A0A1A9I5Z1 | Cas9__A0A1A9I5Z1__prot | 1220 |
| 794 | W0EYD8 | Cas9__W0EYD8__prot | 1221 |
| 795 | E2N1F9 | Cas9__E2N1F9__prot | 1222 |
| 796 | D7VKD0 | Cas9__D7VKD0__prot | 1223 |
| 797 | R7N9S8 | Cas9__R7N9S8__prot | 1224 |
| 798 | C7M7G9 | Cas9__C7M7G9__prot | 1225 |
| 799 | J0WLS6 | Cas9__J0WLS6__prot | 1226 |
| 800 | A0A174L7S6 | Cas9__A0A174L7S6__prot | 1227 |
| 801 | S2KA46 | Cas9__S2KA46__prot | 1228 |
| 802 | A0A0A2F4C3 | Cas9__A0A0A2F4C3__prot | 1229 |
| 803 | U2JCC9 | Cas9__U2JCC9__prot | 1230 |
| 804 | A0A136MV65 | Cas9__A0A136MV65__prot | 1231 |
| 805 | K1M8Y6 | Cas9__K1M8Y6__prot | 1232 |
| 806 | F9YQX1 | Cas9__F9YQX1__prot | 1233 |
| 807 | A0A0B7IQ14 | Cas9__A0A0B7IQ14__prot | 1234 |
| 808 | A0A0B7IB79 | Cas9__A0A0B7IB79__prot | 1235 |
| 809 | A0A0A2EHM8 | Cas9__A0A0A2EHM8__prot | 1236 |
| 810 | A0A173V1H2 | Cas9__A0A173V1H2__prot | 1237 |
| 811 | R7DKC0 | Cas9__R7DKC0__prot | 1238 |
| 812 | U5CHH4 | Cas9__U5CHH4__prot | 1239 |
| 813 | L1NKM1 | Cas9__L1NKM1__prot | 1240 |
| 814 | A0A127VAB0 | Cas9__A0A127VAB0__prot | 1241 |
| 815 | D7JGI6 | Cas9__D7JGI6__prot | 1242 |
| 816 | A0A0U3BTM1 | Cas9__A0A0U3BTM1__prot | 1243 |
| 817 | A0A0M4G8J7 | Cas9__A0A0M4G8J7__prot | 1244 |
| 818 | A0A0A6Y3B0 | Cas9__A0A0A6Y3B0__prot | 1245 |
| 819 | A0A015SZB2 | Cas9__A0A015SZB2__prot | 1246 |
| 820 | A0A0E2RG29 | Cas9__A0A0E2RG29__prot | 1247 |
| 821 | A0A0E2A7Q9 | Cas9__A0A0E2A7Q9__prot | 1248 |
| 822 | A0A015Y7X0 | Cas9__A0A015Y7X0__prot | 1249 |
| 823 | A0A0E2SQU9 | Cas9__A0A0E2SQU9__prot | 1250 |
| 824 | A0A0E2T2C8 | Cas9__A0A0E2T2C8__prot | 1251 |
| 825 | A0A017N289 | Cas9__A0A017N289__prot | 1252 |
| 826 | A0A015UHU2 | Cas9__A0A015UHU2__prot | 1253 |
| 827 | E5C8Y3 | Cas9__E5C8Y3__prot | 1254 |
| 828 | C2M5N8 | Cas9__C2M5N8__prot | 1255 |
| 829 | J4XAP6 | Cas9__J4XAP6__prot | 1256 |
| 830 | A0A1B8ZVU5 | Cas9__A0A1B8ZVU5__prot | 1257 |
| 831 | A0A1E5KUU0 | Cas9__A0A1E5KUU0__prot | 1258 |
| 832 | A0A1E9S993 | Cas9__A0A1E9S993__prot | 1259 |
| 833 | F0P0P2 | Cas9__F0P0P2__prot | 1260 |
| 834 | B7B6H7 | Cas9__B7B6H7__prot | 1261 |
| 835 | W1R7X2 | Cas9__W1R7X2__prot | 1262 |
| 836 | X5KBF9 | Cas9__X5KBF9__prot | 1263 |
| 837 | A0A0B7HB18 | Cas9__A0A0B7HB18__prot | 1264 |
| 838 | I8UMX3 | Cas9__I8UMX3__prot | 1265 |
| 839 | L1PRF6 | Cas9__L1PRF6__prot | 1266 |
| 840 | S3CB04 | Cas9__S3CB04__prot | 1267 |
| 841 | A0A098LI38 | Cas9__A0A098LI38__prot | 1268 |
| 842 | A0A125S8K9 | Cas9__A0A125S8K9__prot | 1269 |
| 843 | E6K6M2 | Cas9__E6K6M2__prot | 1270 |
| 844 | A0A1E5UGK6 | Cas9__A0A1E5UGK6__prot | 1271 |
| 845 | F2IKJ5 | Cas9__F2IKJ5__prot | 1272 |
| 846 | A0A150XH78 | Cas9__A0A150XH78__prot | 1273 |
| 847 | G8X9H3 | Cas9__G8X9H3__prot | 1274 |
| 848 | A0A109Q6P7 | Cas9__A0A109Q6P7__prot | 1275 |
| 849 | A0A101CFI9 | Cas9__A0A101CFI9__prot | 1276 |
| 850 | A0A0T0M2G2 | Cas9__A0A0T0M2G2__prot | 1277 |
| 851 | K1I305 | Cas9__K1I305__prot | 1278 |
| 852 | L1P954 | Cas9__L1P954__prot | 1279 |
| 853 | J0DFD8 | Cas9__J0DFD8__prot | 1280 |
| 854 | H1YII5 | Cas9__H1YII5__prot | 1281 |
| 855 | G2Z1C1 | Cas9__G2Z1C1__prot | 1282 |
| 856 | A0A1E5TBF5 | Cas9__A0A1E5TBF5__prot | 1283 |
| 857 | A0A0K1NMP1 | Cas9__A0A0K1NMP1__prot | 1284 |
| 858 | A0A0E3VRY2 | Cas9__A0A0E3VRY2__prot | 1285 |
| 859 | A0A133Q212 | Cas9__A0A133Q212__prot | 1286 |
| 860 | A0A1E4APC4 | Cas9__A0A1E4APC4__prot | 1287 |
| 861 | U2QLH7 | Cas9__U2QLH7__prot | 1288 |
| 862 | A0A1D3UU01 | Cas9__A0A1D3UU01__prot | 1289 |
| 863 | A0A096CIC5 | Cas9__A0A096CIC5__prot | 1290 |

TABLE 2-continued

Cas9 proteins of the invention

| Row | Column A Protein Acc. No. | Protein (Cas9/Cpf1) | Column B SEQ ID NO |
|---|---|---|---|
| 864 | I4ZCD3 | Cas9__I4ZCD3__prot | 1291 |
| 865 | A0A137SV51 | Cas9__A0A137SV51__prot | 1292 |
| 866 | A0A0X8BZ89 | Cas9__A0A0X8BZ89__prot | 1293 |
| 867 | A0A096D253 | Cas9__A0A096D253__prot | 1294 |
| 868 | A0A134B2X0 | Cas9__A0A134B2X0__prot | 1295 |
| 869 | D1W1M7 | Cas9__D1W1M7__prot | 1296 |
| 870 | U2LB41 | Cas9__U2LB41__prot | 1297 |
| 871 | C9MPM6 | Cas9__C9MPM6__prot | 1298 |
| 872 | R7D4J2 | Cas9__R7D4J2__prot | 1299 |
| 873 | A0A1C5L2R1 | Cas9__A0A1C5L2R1__prot | 1300 |
| 874 | A0A1D3UYE2 | Cas9__A0A1D3UYE2__prot | 1301 |
| 875 | R9I6A5 | Cas9__R9I6A5__prot | 1302 |
| 876 | A0A0M1W3D2 | Cas9__A0A0M1W3D2__prot | 1303 |
| 877 | R7NZZ9 | Cas9__R7NZZ9__prot | 1304 |
| 878 | A0A0P7AYC1 | Cas9__A0A0P7AYC1__prot | 1305 |
| 879 | F3ZS64 | Cas9__F3ZS64__prot | 1306 |
| 880 | B6W3J8 | Cas9__B6W3J8__prot | 1307 |
| 881 | I9UHX4 | Cas9__I9UHX4__prot | 1308 |
| 882 | F9DDR2 | Cas9__F9DDR2__prot | 1309 |
| 883 | A0A069SLB0 | Cas9__A0A069SLB0__prot | 1310 |
| 884 | K4I9M9 | Cas9__K4I9M9__prot | 1311 |
| 885 | F3PY63 | Cas9__F3PY63__prot | 1312 |
| 886 | E5WV33 | Cas9__E5WV33__prot | 1313 |
| 887 | R5MDQ9 | Cas9__R5MDQ9__prot | 1314 |
| 888 | R5K6G6 | Cas9__R5K6G6__prot | 1315 |
| 889 | S0FEG1 | Cas9__S0FEG1__prot | 1316 |
| 890 | A0A078PYN7 | Cas9__A0A078PYN7__prot | 1317 |
| 891 | E5CB73 | Cas9__E5CB73__prot | 1318 |
| 892 | U6RJS5 | Cas9__U6RJS5__prot | 1319 |
| 893 | A0A1B7ZF33 | Cas9__A0A1B7ZF33__prot | 1320 |
| 894 | C9RJP1 | Cas9__C9RJP1__prot | 1321 |
| 895 | I8X6S1 | Cas9__I8X6S1__prot | 1322 |
| 896 | A0A0D0IUN5 | Cas9__A0A0D0IUN5__prot | 1323 |
| 897 | E1Z024 | Cas9__E1Z024__prot | 1324 |
| 898 | A0A173UDH4 | Cas9__A0A173UDH4__prot | 1325 |
| 899 | A0A0J9G920 | Cas9__A0A0J9G920__prot | 1326 |
| 900 | A0A1C2BS21 | Cas9__A0A1C2BS21__prot | 1327 |
| 901 | A0A174HS76 | Cas9__A0A174HS76__prot | 1328 |
| 902 | R6V444 | Cas9__R6V444__prot | 1329 |
| 903 | A0A167Y4I1 | Cas9__A0A167Y4I1__prot | 1330 |
| 904 | R7ZSP8 | Cas9__R7ZSP8__prot | 1331 |
| 905 | W4PXW0 | Cas9__W4PXW0__prot | 1332 |
| 906 | U2DMI6 | Cas9__U2DMI6__prot | 1333 |
| 907 | W4PHU4 | Cas9__W4PHU4__prot | 1334 |
| 908 | I4A2W8 | Cas9__I4A2W8__prot | 1335 |
| 909 | G8XA12 | Cas9__G8XA12__prot | 1336 |
| 910 | A0A1B9E9Q0 | Cas9__A0A1B9E9Q0__prot | 1337 |
| 911 | R5CLM1 | Cas9__R5CLM1__prot | 1338 |
| 912 | A0A180FK19 | Cas9__A0A180FK19__prot | 1339 |
| 913 | R6E3D1 | Cas9__R6E3D1__prot | 1340 |
| 914 | A0A101CN94 | Cas9__A0A101CN94__prot | 1341 |
| 915 | A0A0K8QW18 | Cas9__A0A0K8QW18__prot | 1342 |
| 916 | A0A1H6BLP7 | Cas9__A0A1H6BLP7__prot | 1343 |
| 917 | R5ZG15 | Cas9__R5ZG15__prot | 1344 |
| 918 | I0AP30 | Cas9__I0AP30__prot | 1345 |
| 935 | Q99ZW2 | NLS2__STRP1(SF370)cas9__Q99ZW2__NLS4__prot | 1362 |
| 936 | A0Q5Y3 | NLS2__cas9__A0Q5Y3__NLS4__prot | 1363 |
| 937 | J7RUA5 | NLS2__cas9__J7RUA5__NLS4__prot | 1364 |
| 938 | G3ECR1 | NLS2__cas9-G3ECR1__NLS4__prot | 1365 |
| 939 | J3F2B0 | NLS2__cas9__J3F2B0__NLS4__prot | 1366 |
| 940 | Q03JI6 | NLS2__cas9__Q03JI6__NLS4__prot | 1367 |
| 941 | C9X1G5 | NLS2__cas9__C9X1G5__NLS4__prot | 1368 |
| 942 | Q927P4 | NLS2__cas9__Q927P4__NLS4__prot | 1369 |
| 943 | Q8DTE3 | NLS2__cas9__Q8DTE3__NLS4__prot | 1370 |
| 944 | Q9CLT2 | NLS2__cas9__Q9CLT2__NLS4__prot | 1371 |
| 945 | A1IQ68 | NLS2__cas9__A1IQ68__NLS4__prot | 1372 |
| 946 | Q6NKI3 | NLS2__cas9__Q6NKI3__NLS4__prot | 1373 |
| 947 | Q0P897 | NLS2__cas9__Q0P897__NLS4__prot | 1374 |
| 948 | Q03LF7 | NLS2__cas9__Q03LF7__NLS4__prot | 1375 |

In preferred embodiments, the inventive artificial nucleic acid molecule thus comprises a coding sequence comprising or consisting of a nucleic acid sequence encoding a Cas9 protein as defined by the database accession number provided under the respective column in Table 2, or a homolog, variant, fragment or derivative thereof. In particular, the encoded Cas9 protein may preferably comprise or consist of an amino acid sequence as indicated under the respective column in Table 2, or a homolog, variant, fragment or derivative thereof.

Specifically, in preferred embodiments the inventive artificial nucleic acid molecule may thus comprise a coding sequence comprising or consisting of a nucleic acid sequence encoding a Cas9 protein comprising or consisting of an amino acid sequence as defined by any one of SEQ ID NOs: 428-1375, or a (functional) homolog, variant, fragment or derivative thereof, in particular an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

In particular, the encoded Cas9 protein may preferably comprise at least one nuclear localization signal (NLS), more preferably two NLS selected from NLS2 and NLS4 as defined above. In preferred embodiments, the inventive artificial nucleic acid molecule may thus comprise a coding sequence comprising or consisting of a nucleic acid sequence encoding a Cas9 protein with nuclear localization signals, comprising or consisting of an amino acid sequence as defined by any one of SEQ ID NOs: 426; 427; 10575; 381; 382; 384; 11957; 11958-11964 or SEQ ID NOs: 12021-14274, or a (functional) homolog, variant, fragment or derivative thereof, in particular an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

Preferred functional Cas9 variants envisaged herein include inter "deadCas9 (dCas9)" and "Cas9 nickases".

The term "dCas9" refers to a nuclease-deactivated Cas9, also termed "catalytically inactive", "catalytically dead Cas9" or "dead Cas9." Such nucleases lack all or a portion of endonuclease activity and can therefore be used to regulate genes in an RNA-guided manner (Jinek M et al. Science. 2012 Aug. 17; 337(6096):816-21). dCas9 nucleases comprise mutations that inactivate Cas9 endonuclease activity, typically in both of the two catalytic residues (D10A in the RuvC-1 domain, and H840A in the HNH domain, numbered relative to S. pyogenes Cas9 i.e. spCas9). Other catalytic residues can however also be mutated in order to reduce activity of either or both of the nuclease domains. dCas9 is preferably unable to cleave dsDNA but retains its ability to associate with suitable gRNAs and specifically bind to target DNA. The Cas9 double mutant with changes at amino acid positions D10A and H840A completely inactivates both the nuclease and nickase activities. Cas9 derivatives based on "dCas9" can be used to shuttle additional effector domains to a target DNA sequence, thereby inducing, for instance, CRISPRa or CRISPRi (as discussed elsewhere herein).

The term "Cas9 nickase" refers to Cas9 variants that do not retain the ability to introduce double-stranded breaks in a target nucleic acid sequence, but maintains the ability to bind to and introduce a single-stranded break at a target site. Such variants will typically include a mutation in one, but not both of the Cas9 endonuclease domains (HNH and RuvC). Thus, an amino acid mutation at position D10A or H840A in Cas9, numbered relative to the S. pyogenes Cas9 i.e. spCas9, can result in the inactivation of the nuclease catalytic activity and convert Cas9 to a nickase.

Further Cas9 variants are known in the art and envisaged as variants in accordance with the present invention. U.S. Patent Application No. 20140273226, discusses the S. pyogenes Cas9 gene, Cas9 protein, and variants of the Cas9 protein including host-specific codon optimized Cas9 coding sequences and Cas9 fusion proteins. U.S. Patent Application No. 20140315985 teaches a large number of exemplary wild-type Cas9 polypeptides (e.g., SEQ ID NO: 1-256, SEQ ID NOS: 795-1346 of US Patent Application No. 20140273226) including the sequence of Cas9 from S. pyogenes(SEQ ID NO: 8 of US Patent Application No. 20140273226). Modifications and variants of Cas9 proteins are also discussed. The disclosure of these references is incorporated herein in its entirety.

In further embodiments, artificial nucleic acids according to the invention encode a Cas9 protein, or an isoform, homolog, variant, fragment or derivative thereof, as indicated in table 2 of PCT/EP2017/076775, which is incorporated by reference in its entirety herein. E.g., the inventive artificial nucleic acids may thus comprise at least one coding sequence encoding a Cas9 protein comprising or consisting of an amino acid sequence as defined by any one of SEQ ID NOs: 428-1345 or 1362-1375 of PCT/EP2017/076775, or a (functional) isoform, homolog, variant, fragment or derivative thereof.

Nucleic Acid Sequences

In preferred embodiments, the inventive artificial nucleic acid molecule may comprise a coding sequence comprising or consisting of a nucleic acid sequence encoding a Cas9 protein as defined herein, wherein said nucleic acid sequence is defined by any one of SEQ ID NOs: 412; 3474-3887; 2314-2327; 4634-4647; 5794-5807; 6954-6967; 8114-8127; 413-425; 3490-3503; 3506-3519; 3522-3535; 3538-3551; 3554-3567; 3570-3583; 3586-3599; 3602-3615; 3618-3631; 3634-3647; 3650-3663; 3666-3679; 3682-3695; 9514-9527; 9626-9639; 9738-9751; 9850-9863; 9962-9975, 10074-10087; 10186-10199; 10298-10311; 2330-2343; 2346-2359; 2362-2375; 2378-2391; 2394-2407; 2410-2423; 2426-2439; 2442-2455; 2458-2471; 2474-2487; 2490-2503; 2506-2519; 2522-2535; 9498-9511; 9610-9623; 9722-9735; 9834-9847; 9946-9959; 10058-10071; 10170-10183-10282-10295; 4650-4663; 4666-4679; 4682-4695; 4698-4711; 4714-4727; 4730-4743; 4746-4759; 4762-4775; 4778-4791; 4794-4807; 4810-4823; 4826-4839; 4842-4855; 9530-9543; 9642-9655; 9754-9767; 9866-9879; 9978-9991; 10090-10103; 10202-10215; 10314-10327; 5810-5823; 5826-5839; 5842-5855; 5858-5871; 5874-5887; 5890-5903; 5906-5919; 5922-5935; 5938-5951; 5954-5967; 5970-5983, 5986-5999; 6002-6015; 9546-9559; 9658-9671; 9770-9783; 9882-9895; 9994-10007; 10106-10119; 10218-10231; 10330-10343; 6970-6983; 6986-6999; 7002-7015; 7018-7031; 7034-7047; 7050-7063; 7066-7079; 7082-7095; 7098-7111; 7114-7127; 7130-7143; 7146-7159; 7162-7175; 9562-9575; 9674-9687; 9786-9799; 9898-9911; 10010-10023; 10122-10135;

10234-10247; 10346-10359; 8130-8143; 8146-8159; 8162-8175; 8178-8191; 8194-8207; 8210-8223; 8226-8239; 8242-8255; 8258-8271; 8274-8287; 8290-8302; 8306-8319; 8322-8335; 9578-9591; 9690-9703; 9802-9815; 9914-9927; 10026-10039; 10138-10151; 10250-10263; 10362-10375; 9290-9303; 9306-9319; 9322-9335; 9338-9351; 9354-9367; 9370-9383; 9386-9399; 9402-9415; 9418-9431; 9434-9447; 9450-9463; 9466-9479; 9482-9495; 9594-9607; 9706-9719; 9818-9831; 9930-9943; 10042-10055; 10154-10167; 10266-10279; 10378-10391; 27; 996-1009; 2156-2169; 3316-3329; 4476-4489; 5636-5649; 6796-6809; 7956-7969; 1010-1913; 2170-3073; 3330-4233; 4490-5393; 5650-6553; 6810-7713; 7970-8873, or a (functional) homolog, variant, fragment or derivative thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

In preferred embodiments, inventive artificial nucleic acids further encode, in their coding region, at least one nuclear localization signal. The nucleic acid sequence encoding the nuclear localization signal(s) is/are preferably fused to the nucleic acid encoding the Cas9 protein, or a homolog, variant, fragment or derivative thereof, as defined herein, so as to facilitate transport of said Cas9 protein, or its homolog, variant, fragment or derivative, into the nucleus. In preferred embodiments, artificial nucleic acids thus comprise or consist of a nucleic acid sequence encoding a Cas9 protein, or a homolog, variant, fragment or derivative thereof, fused to at least one nuclear localization signal, said nucleic acid sequence preferably being defined by any one of SEQ ID NOs: 409; 2538; 410; 2539; 10551; 10581; 11973; 11974-11980; 1378; 3698; 4858; 6018; 7178; 8338; 1379; 3699; 4859; 6019; 7179; 8339; 10593; 10584; 10587; 10590; 10593; 10596; 11965; 11981; 11989; 11997; 12005; 12013; 11966-11972; 11982-11988; 11990-11996; 11998-12004; 12006-12012; 12014-12020 or any nucleic acid sequence encoding the protein SEQ ID NOs: 12021-14274, or a (functional) homolog, variant, fragment or derivative thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

The present invention envisages the beneficial combination of CRISPR-associated protein encoding regions with UTRs as defined herein, in order to preferably increase the expression of said encoded proteins. In preferred embodiments, artificial nucleic acids thus comprise or consist of a nucleic acid sequence encoding a Cas9 protein or a homolog, variant, fragment or derivative thereof fused to at least one nuclear localization signal, said nucleic acid sequence preferably being defined by any one of SEQ ID Nos: 412; 3474-3887; 2314-2327; 4634-4647; 5794-5807; 6954-6967; 8114-8127; 413-425; 3490-3503; 3506-3519; 3522-3535; 3538-3551; 3554-3567; 3570-3583; 3586-3599; 3602-3615; 3618-3631; 3634-3647; 3650-3663; 3666-3679; 3682-3695; 9514-9527; 9626-9639; 9738-9751; 9850-9863; 9962-9975, 10074-10087; 10186-10199; 10298-10311; 2330-2343; 2346-2359; 2362-2375; 2378-2391; 2394-2407; 2410-2423; 2426-2439; 2442-2455; 2458-2471; 2474-2487; 2490-2503; 2506-2519; 2522-2535; 9498-9511; 9610-9623; 9722-9735; 9834-9847; 9946-9959; 10058-10071; 10170-10183-10282-10295; 4650-4663; 4666-4679; 4682-4695; 4698-4711; 4714-4727; 4730-4743; 4746-4759; 4762-4775; 4778-4791; 4794-4807; 4810-4823; 4826-4839; 4842-4855; 9530-9543; 9642-9655; 9754-9767; 9866-9879; 9978-9991; 10090-10103; 10202-10215; 10314-10327; 5810-5823; 5826-5839; 5842-5855; 5858-5871; 5874-5887; 5890-5903; 5906-5919; 5922-5935; 5938-5951; 5954-5967; 5970-5983, 5986-5999; 6002-6015; 9546-9559; 9658-9671; 9770-9783; 9882-9895; 9994-10007; 10106-10119; 10218-10231; 10330-10343; 6970-6983; 6986-6999; 7002-7015; 7018-7031; 7034-7047; 7050-7063; 7066-7079; 7082-7095; 7098-7111; 7114-7127; 7130-7143; 7146-7159; 7162-7175; 9562-9575; 9674-9687; 9786-9799; 9898-9911; 10010-10023; 10122-10135; 10234-10247; 10346-10359; 8130-8143; 8146-8159; 8162-8175; 8178-8191; 8194-8207; 8210-8223; 8226-8239; 8242-8255; 8258-8271; 8274-8287; 8290-8302; 8306-8319; 8322-8335; 9578-9591; 9690-9703; 9802-9815; 9914-9927; 10026-10039; 10138-10151; 10250-10263; 10362-10375; 9290-9303; 9306-9319; 9322-9335; 9338-9351; 9354-9367; 9370-9383; 9386-9399; 9402-9415; 9418-9431; 9434-9447; 9450-9463; 9466-9479; 9482-9495; 9594-9607; 9706-9719; 9818-9831; 9930-9943; 10042-10055; 10154-10167; 10266-10279; 10378-10391, or a (functional) homolog, variant, fragment or derivative thereof, in particular nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

The present invention envisages the beneficial combination of CRISPR-associated protein encoding regions with UTRs as defined herein, in order to preferably increase the expression of said encoded proteins. In preferred embodiments, artificial nucleic acids thus comprise or consist of a nucleic acid sequence encoding a Cas9 protein or a homolog, variant, fragment or derivative thereof fused to at least one nuclear localization signal, said nucleic acid sequence preferably being defined by any SEQ ID NO selected from the group consisting of SEQ ID NO: 14274, SEQ ID NO: 14275, SEQ ID NO: 14276, SEQ ID NO: 14277, SEQ ID NO: 14278, SEQ ID NO: 14279, SEQ ID NO: 14280, SEQ ID NO: 14281, and SEQ ID NO: 14282; more preferably SEQ ID NO: 14281, SEQ ID NO: 417 (HSD17B4/PSMB3.1 i.e. construct HSD17B4_NLS2_STRP1(SF370)-cas9_HsOpt_NLS4_PSMB3.1;
Hsopt=*Homo sapiens* optimization) or SEQ ID NO:414 (Slc7a3.1/Gnas1, i.e. construct Scl7a3.1_NLS2_STRP1 (SF370)-cas9_HsOpt_NLS4_Gnas.1).

Advantageously, any Cas9 sequence as disclosed can be selected for the inventive use i.e. any sequence as mentioned above i.e. as disclosed herein and/or in the sequence listing, i.e. Cas9 protein sequences and mRNAs encoding different versions of the respective Cas9 protein sequences i.e. WT or optimized sequences.

Further, the precise excision of the CAG Tract from the Huntingtin Gene by Cas9 nickases is comprised within the teaching of the invention by reference to PMID 29535594 which is incorporated herein by reference. Also, the programmable RNA cleavage and recognition by a natural CRISPR-Cas9 System from *Neisseria meningitides* is comprised within the teaching of the invention by reference to PMID 29456189 which is incorporated herein by reference. Further, CRISPR RNA-dependent binding and cleavage of endogenous RNAs by the *Campylobacter jejuni* Cas9 is comprised within the teaching of the invention by reference to PMID 29499139 which is incorporated herein by reference. Also in vivo target gene activation via CRISPR/Cas9-Mediated trans-epigenetic modulation is comprised within the teaching of the invention by reference to PMID 29224783 which is incorporated herein by reference.

In a further embodiment, the present invention envisages also the nucleic acid sequences as shown in Table 2A.

TABLE 2A

Further preferred optimized Cas9 sequences of the invention

| 5' UTR | Cas9 incl. NLS | 3'UTR | SEQ ID NO |
|---|---|---|---|
| Slc7a3.1 | NLS2__STRP1(SF370)-cas9(opt1)__NLS4 | Gnas.1 | 14521 |
| Ubqln2.1 | NLS2__STRP1(SF370)-cas9(opt1)__NLS4 | RPS9.1 | 14522 |
| HSD17B4 | NLS2__STRP1(SF370)-cas9(opt1)__NLS4 | PSBM3 | 14523 |
| HSD17B4 | NLS2__STRP1(SF370)-cas9(opt1)__NLS4 | Gnas.1 | 14524 |
| Nosip.1 | NLS2__STRP1(SF370)-cas9(opt1)__NLS4 | Ndufa1.1 | 14525 |
| Mp68 | NLS2__STRP1(SF370)-cas9(opt1)__NLS4 | Gnas.1 | 14526 |
| Mp68 | NLS2__STRP1(SF370)-cas9(opt1)__NLS4 | Ndufa1.1 | 14527 |
| Slc7a3.1 | NLS2__STRP1(SF370)-cas9(opt2)__NLS4 | Gnas.1 | 14528 |
| Ubqln2.1 | NLS2__STRP1(SF370)-cas9(opt2)__NLS4 | RPS9.1 | 14529 |
| HSD17B4 | NLS2__STRP1(SF370)-cas9(opt2)__NLS4 | PSBM3 | 14530 |
| HSD17B4 | NLS2__STRP1(SF370)-cas9(opt2)__NLS4 | Gnas.1 | 14531 |
| Nosip.1 | NLS2__STRP1(SF370)-cas9(opt2)__NLS4 | Ndufa1.1 | 14532 |
| Mp68 | NLS2__STRP1(SF370)-cas9(opt2)__NLS4 | Gnas.1 | 14533 |
| Mp68 | NLS2__STRP1(SF370)-cas9(opt2)__NLS4 | Ndufa1.1 | 14534 |
| Slc7a3.1 | NLS2__STRP1(SF370)-cas9(opt10)__NLS4 | Gnas.1 | 14535 |
| Ubqln2.1 | NLS2__STRP1(SF370)-cas9(opt10)__NLS4 | RPS9.1 | 14536 |
| HSD17B4 | NLS2__STRP1(SF370)-cas9(opt10)__NLS4 | PSBM3 | 14537 |
| HSD17B4 | NLS2__STRP1(SF370)-cas9(opt10)__NLS4 | Gnas.1 | 14538 |
| Nosip.1 | NLS2__STRP1(SF370)-cas9(opt10)__NLS4 | Ndufa1.1 | 14539 |
| Mp68 | NLS2__STRP1(SF370)-cas9(opt10)__NLS4 | Gnas.1 | 14540 |
| Mp68 | NLS2__STRP1(SF370)-cas9(opt10)__NLS4 | Ndufa1.1 | 14541 |

In a further embodiment, NLS2_STRP1(SF370)-cas9_HsOpt_NLS4 (SEQ ID NO: 412) is combined with the UTR-combinations as shown in Table 2A, i.e. with Slc7a3.1 (SEQ ID NO: 15/16)/Gnas.1 (SEQ ID NO: 29/30).

TABLE 2B

Further preferred Cas9 sequences of the invention

| 5' UTR | Cas9 (Hsopt) incl. NLS | 3'UTR | SEQ ID NO |
|---|---|---|---|
| Slc7a3.1 | NLS2__STRP1(SF370)-cas9__HsOpt__NLS4 | Gnas.1 | 414 |
| Ubqln2.1 | NLS2__STRP1(SF370)-cas9__HsOpt__NLS4 | RPS9.1 | 14542 |
| HSD17B4(V2) | NLS2__STRP1(SF370)-cas9__HsOpt__NLS4 | PSBM3 | 417 |
| HSD17B4(V2) | NLS2__STRP1(SF370)-cas9__HsOpt__NLS4 | Gnas.1 | 14543 |
| Nosip.1 | NLS2__STRP1(SF370)-cas9__HsOpt__NLS4 | Ndufa1.1 | 14544 |
| Mp68 | NLS2__STRP1(SF370)-cas9__HsOpt__NLS4 | Gnas.1 | 14545 |
| Mp68 | NLS2__STRP1(SF370)-cas9__HsOpt__NLS4 | Ndufa1.1 | 14546 |

In further embodiments, the artificial nucleic acid sequences according to the invention may comprise or consist of a nucleic acid sequence according to SEQ ID NOs: 1380-1393; 1394-2297; 2314-2327; 2330-2343; 2346-2359; 2362-2375; 2378-2391; 2394-2407; 2410-2423; 2426-2439; 2442-2455; 2458-2471; 2474-2487; 2490-2503; 2506-2519; 2522-2535; 9498-9511; 9610-9623; 9722-9735; 9834-9847; 9946-9959; 10058-10071; 10170-10183-10282-10295; 2540-2553; 2554-3457; 3474-3887; 3490-3503; 3506-3519; 3522-3535; 3538-3551; 3554-3567; 3570-3583; 3586-3599; 3602-3615; 3618-3631; 3634-3647; 3650-3663; 3666-3679; 3682-3695; 9514-9527; 9626-9639; 9738-9751; 9850-9863; 9962-9975, 10074-10087; 10186-10199; 10298-10311; 3700-3713; 3714-4617; 4634-4647; 4650-4663; 4666-4679; 4682-4695; 4698-4711; 4714-4727; 4730-4743; 4746-4759; 4762-4775; 4778-4791; 4794-4807; 4810-4823; 4826-4839; 4842-4855; 9530-9543; 9642-9655; 9754-9767; 9866-9879; 9978-9991; 10090-10103; 10202-10215; 10314-10327; 4860-4873; 4874-5777; 5794-5807; 5810-5823; 5826-5839; 5842-5855; 5858-5871; 5874-5887; 5890-5903; 5906-5919; 5922-5935; 5938-5951; 5954-5967; 5970-5983, 5986-5999; 6002-6015; 9546-9559; 9658-9671; 9770-9783; 9882-9895; 9994-10007; 10106-10119; 10218-10231; 10330-10343; 6020-6033; 6034-6937; 6954-6967; 6970-6983; 6986-6999; 7002-7015; 7018-7031; 7034-7047; 7050-7063; 7066-7079; 7082-7095; 7098-7111; 7114-7127; 7130-7143; 7146-7159; 7162-7175; 9562-9575; 9674-9687; 9786-9799; 9898-9911; 10010-10023; 10122-10135; 10234-10247; 10346-10359; 7180-7193; 7194-8097; 8114-8127; 8130-8143; 8146-8159; 8162-8175; 8178-8191; 8194-8207; 8210-8223; 8226-8239; 8242-8255; 8258-8271; 8274-8287; 8290-8302; 8306-8319; 8322-8335; 9578-9591; 9690-9703; 9802-9815; 9914-9927; 10026-10039; 10138-10151; 10250-10263; 10362-10375; 8340-8353; 8354-9257; 9274-9287; 9290-9303; 9306-9319; 9322-9335; 9338-9351; 9354-9367; 9370-9383; 9386-9399; 9402-9415; 9418-9431; 9434-9447; 9450-9463; 9466-9479; 9482-9495; 9594-9607; 9706-9719; 9818-9831; 9930-9943; 10042-10055; 10154-10167; 10266-10279; 10378-10391; 411; 1380-1393; 2540-2553; 3700-3713; 4860-4873; 6020-6033; 7180-7193; 8340-8353; 1394-2297; 2554-3457; 3714-4617; 4874-5777; 6034-6937; 7194-8097; 8354-9257; 2314-2327; 3474-3887; 4634-4647; 5794-5807; 6954-6967; 8114-8127;

9274-9287; 413-425; 2330-2343; 2346-2359; 2362-2375; 2378-2391; 2394-2407; 2410-2423; 2426-2439; 2442-2455; 2458-2471; 2474-2487; 2490-2503; 2506-2519; 2522-2535; 9498-9511; 9610-9623; 9722-9735; 9834-9847; 9946-9959; 10058-10071; 10170-10183-10282-10295; 3490-3503; 3506-3519; 3522-3535; 3538-3551; 3554-3567; 3570-3583; 3586-3599; 3602-3615; 3618-3631; 3634-3647; 3650-3663; 3666-3679; 3682-3695; 9514-9527; 9626-9639; 9738-9751; 9850-9863; 9962-9975, 10074-10087; 10186-10199; 10298-10311; 4650-4663; 4666-4679; 4682-4695; 4698-4711; 4714-4727; 4730-4743; 4746-4759; 4762-4775; 4778-4791; 4794-4807; 4810-4823; 4826-4839; 4842-4855; 9530-9543; 9642-9655; 9754-9767; 9866-9879; 9978-9991; 10090-10103; 10202-10215; 10314-10327; 5810-5823; 5826-5839; 5842-5855; 5858-5871; 5874-5887; 5890-5903; 5906-5919; 5922-5935; 5938-5951; 5954-5967; 5970-5983; 5986-5999; 6002-6015; 9546-9559; 9658-9671; 9770-9783; 9882-9895; 9994-10007; 10106-10119; 10218-10231; 10330-10343; 6970-6983; 6986-6999; 7002-7015; 7018-7031; 7034-7047; 7050-7063; 7066-7079; 7082-7095; 7098-7111; 7114-7127; 7130-7143; 7146-7159; 7162-7175; 9562-9575; 9674-9687; 9786-9799; 9898-9911; 10010-10023; 10122-10135; 10234-10247; 10346-10359; 8130-8143; 8146-8159; 8162-8175; 8178-8191; 8194-8207; 8210-8223; 8226-8239; 8242-8255; 8258-8271; 8274-8287; 8290-8302; 8306-8319; 8322-8335; 9578-9591; 9690-9703; 9802-9815; 9914-9927; 10026-10039; 10138-10151; 10250-10263; 10362-10375; 9290-9303; 9306-9319; 9322-9335; 9338-9351; 9354-9367; 9370-9383; 9386-9399; 9402-9415; 9418-9431; 9434-9447; 9450-9463; 9466-9479; 9482-9495; 9594-9607; 9706-9719; 9818-9831; 9930-9943; 10042-10055; 10154-10167; 10266-10279; 10378-10391 of PCT/EP2017/076775, or (functional) homologs, fragments, variants or derivatives thereof.

Cpf1

"Cpf1" ("CRISPR from *Prevotella* and *Francisella* 1") or "Cas12" refers to RNA-guided DNA endonucleases, which belong to the putative class 2 type V CRISPR-Cas systems (Zetsche et al., Cell. 2015 Oct. 22; 163(3): 759-771), and homologs, variants, fragments and derivatives thereof. Cpf1-encoding genes include the *Francisella tularensis* subsp. *novicida* (strain 0112) cpf1 gene (NCBI Reference Sequence: NZ_CP009633.1, "AW25_RS03035") or homologs, variants or fragments thereof. Based on sequence analysis, Cpf1 contains only one detectable RuvC endonuclease domain, and a second putative novel nuclease (NUC) domain (Zetsche et al., Cell. 2015 Oct. 22; 163(3): 759-771, Gao et al. Cell Res. 2016 August; 26(8):901-13).

Cpf1 proteins preferably associates with a crRNA to forming a Cpf1:crRNA complex that is preferably capable of specifically interacting with a target DNA sequence. Cpf1:crRNA complexes are preferably capable of efficiently cleaving target DNA proceeded by a short T-rich protospacer adjacent motif (PAM) located 5' of the target DNA, and may introduce staggered DNA double stranded breaks with a 4 or 5-nt 5' overhang.

Amino Acid Sequences

Several Cpf1 proteins are known in the art and are envisaged as CRISPR-associated proteins in the context of the present invention. Suitable Cpf1 proteins are listed in Table 3 below. Therein, each row corresponds to a Cpf1 protein as identified by its database accession number (first column, "A", "Acc No."). The second column in Table 3 ("B") indicates the SEQ ID NO: corresponding to the respective amino acid sequence as provided herein. Preferred Cpf1 proteins are shown in the sequence listing under SEQ ID NO:1346-1347; 10576-10577; and 1348-1361. The corresponding optimized mRNA sequences which are preferred embodiment of the invention are shown in the sequence listing under SEQ ID NO: 10552; 3458-3459; 3460-3473 2298-2299; 4618-4619; 5778-5779; 6938-6939; 8098-8099; 9258-9259; 2300-2313; 4620-4633; 5780-5793; 6940-6953; 8100-8113; and 9260-9273.

TABLE 3

Cpf1 proteins

| Row | Column A<br>Acc. No. | Column B<br>SEQ ID NO |
|---|---|---|
| 1 | U2UMQ6 | 1346 |
| 2 | A0Q7Q2 | 1347 |
| 3 | A8WNM2 | 1348 |
| 4 | E3LGD2 | 1349 |
| 5 | A0A182DWE3 | 1350 |
| 6 | A0A0B6KQP9 | 1351 |
| 7 | A0A0E1N6W4 | 1352 |
| 8 | V6HCU8 | 1353 |
| 9 | A0A0E1N9S2 | 1354 |
| 10 | A0A1B8PW75 | 1355 |
| 11 | A0A1J0L0B6 | 1356 |
| 12 | A0A1F3JTA5 | 1357 |
| 13 | A0A1G2R4W1 | 1358 |
| 14 | A0A1F5S360 | 1359 |
| 15 | A0A1F5ENJ2 | 1360 |
| 16 | A0A1J4U637 | 1361 |
| 17 | U2UMQ6 (NLS2_cpf1_U2UMQ6_NLS4_prot) | 1376 |
| 18 | A0Q7Q2 (NLS2_cpf1_A0Q7Q2_NLS4_prot) | 1377 |

In preferred embodiments, the inventive artificial nucleic acid molecule thus comprises a coding sequence comprising or consisting of a nucleic acid sequence encoding a Cpf1 protein as defined by the database accession number provided under the respective column in Table 3, or a homolog, variant, fragment or derivative thereof. In particular, the encoded Cpf1 protein may preferably comprise or consist of an amino acid sequence as indicated under the respective column in Table 3, or a homolog, variant, fragment or derivative thereof.

Specifically, in preferred embodiments the inventive artificial nucleic acid molecule may thus comprise a coding sequence comprising or consisting of a nucleic acid sequence encoding a Cpf1 protein comprising or consisting of an amino acid sequence as defined by any one of SEQ ID NOs: 1346-1347; 10576-10577; or 1348-1361, or a (functional) homolog, variant, fragment or derivative thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

In particular, the encoded Cpf1 protein may preferably comprise at least one nuclear localization signal (NLS), more preferably two NLS selected from NLS2 and NLS4 as defined above. In preferred embodiments, the inventive artificial nucleic acid molecule may thus comprise a coding sequence comprising or consisting of a nucleic acid sequence encoding a Cpf1 protein with nuclear localization signals, comprising or consisting of an amino acid sequence as defined by any one of SEQ ID NOs: 992-993, or a (functional) homolog, variant, fragment or derivative thereof comprising or consisting of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

In further embodiments, artificial nucleic acids according to the invention encode a Cpf1 protein, or an isoform, homolog, variant, fragment or derivative thereof, as indicated in table 3 of PCT/EP2017/076775, which is incorporated by reference in its entirety herein. Specifically, the inventive artificial nucleic acid (RNA) molecule may thus comprise a coding sequence encoding a Cpf1 protein comprising or consisting of an amino acid sequence as defined by any one of SEQ ID NOs: 1346-1361, or 1376-1377 or 10576-10577 of PCT/EP2017/076775, or a (functional) isoform, homolog, variant, fragment or derivative thereof.

Nucleic Acid Sequences

In preferred embodiments, the inventive artificial nucleic acid molecule may comprise a coding sequence comprising or consisting of a nucleic acid sequence encoding a Cpf1 protein as defined herein, wherein said nucleic acid sequence is defined by any one of SEQ ID NOs: 3488-3489; 10396; 2328-2329; 10395; 4648-4649; 10397; 5808-5809; 10398; 6968-6969; 10399; 8128-8129; 10400; 9274-9287; 3504-3505; 3520-3521; 3536-3537; 3552-3553; 3568-3669; 3584-3585; 3600-3601; 3616-3617; 3632-3633; 3648-3649; 3664-3665; 3680-3681; 3696-3697; 9528-9529; 9640-9641; 9752-9753; 9864-9865; 9976-9977; 10088-10089; 10200-10201; 10312-10313; 10403; 10410; 10417; 10424; 10431; 10438; 10445; 10452; 10459; 10466; 10473; 10480; 10487; 10494; 10501; 10508; 10515; 10522; 10529; 10536; 10543; 2344-2345; 2360-2361; 2376-2377; 2392-2393; 2408-2409; 2424-2425; 2440-2441; 2456-2457; 2472-2473; 2489-2490; 2504-2505; 2520-2521; 2536-2537; 9512-9513; 9624-9625; 9736-9737; 9848-9849; 9960-9961; 10072-10073; 10184-10185; 10296-10297; 10402; 10409; 10416; 10423; 10430; 10437; 10444; 10451; 10458; 10465; 10472; 10479; 10486; 10493; 10500; 10507; 10514; 10521; 10528; 10535; 10542; 4664-4665; 4680-4681; 4696-4697; 4712-4713; 4728-4729; 4744-4745; 4760-4761; 4776-4777; 4792-4793; 4808-4809; 4824-4825; 4840-4841; 4856-4857; 9544-9545; 9656-9657; 9768-9769; 9880-9881; 9992-9993; 10104-10105; 10216-10217; 10328-10329; 10404; 10411; 10418; 10425; 10432; 10439; 10446; 10453; 10460; 10467; 10474; 10481; 10488; 10495; 10502; 10509; 10516; 10523; 10530; 10537; 10544; 5824-5825; 5840-5841; 5856-5857; 5872-5873; 5888-5889; 5904-5905; 5920-5921; 5936-5937; 5952-5953; 5968-5969; 5984-5985; 6000-6001; 6016-6017; 9560-9561; 9672-9673; 9784-9785; 9896-9897; 10008-10009; 10120-10121; 10232-10233; 10344-10345; 10405; 10412; 10419; 10426; 10433; 10440; 10447; 10454; 10461; 10468; 10475; 10482; 10489; 10496; 10503; 10510; 10517; 10524; 10531; 10538; 10545; 7033; 7048-7049; 7064-7065; 7080-7081; 7096-7097; 7112-7113; 7128-7129; 7144-7145; 7160-7161; 7176-7177; 9576-9577; 9688-9689; 9800-9801; 9912-9913; 10024-10025; 10136-10137; 10248-10249; 10360-10361; 10406; 10413; 10420; 10427; 10434; 10441; 10448; 10455; 10462; 10469; 10476; 10483; 10490; 10497; 10504; 10511; 10518; 10525; 10532; 10539; 10546; 8144-8145; 8160-8160; 8176-8177; 8192-8193; 8208-8209; 8224-8225; 8240-8241; 8256-8257; 8272-8273; 8288-8289; 8304-8305; 8320-8321; 8336-8337; 9592-9593; 9704-9705; 9816-9817; 9928-9929; 10040-10041; 10152-10153; 10264-10265; 10376-10377; 10407; 10414; 10421; 10428; 10435; 10442; 10449; 10456; 10463; 10470; 10477; 10484; 10491; 10498; 10505; 10512; 10519; 10526; 10533; 10540; 10547; 9288-9289; 10401; 10553; 10582-10583; 10579-10580; 10585-10586; 10588-10589; 10591-10592; 10594-10595; 10597-10598; 10554-10574; 10601; 10602; 10615; 10616; 10629; 10630; 10643; 10644; 10657; 10658; 10671; 10672; 10685; 10686; 10699; 10700; 10713; 10714; 10727; 10728; 10741; 10742; 10755; 10756; 10769; 10770; 10783; 10784; 10797; 10798; 10811; 10812; 10825; 10826; 10839; 10840; 10853; 10854; 10867; 10868; 10881; 10882; 10603; 10604; 10617; 10618; 10631; 10632; 10645; 10646; 10659; 10660; 10673; 10674; 10687; 10688; 10701; 10702; 10715; 10716; 10729; 10730; 10743; 10744; 10757; 10758; 10771; 10772; 10785; 10786; 10799; 10800; 10813; 10814; 10827; 10828; 10841; 10842; 10855; 10856; 10869; 10870; 10883; 10884; 10605; 10606; 10619; 10620; 10633; 10634; 10647; 10648; 10661; 10662; 10675; 10676; 10689; 10690; 10703; 10704; 10717; 10718; 10731; 10732; 10745; 10746; 10759; 10760; 10773; 10774; 10787; 10788; 10801; 10802; 10815; 10816; 10829; 10830; 10843; 10844; 10857; 10858; 10871; 10872; 10885; 10886; 10607; 10608; 10621; 10622; 10635; 10636; 10649; 10650; 10663; 10664; 10677; 10678; 10691; 10692; 10705; 10706; 10719; 10720; 10733; 10734; 10747; 10748; 10761; 10762; 10775; 10776; 10789; 10790; 10803; 10804; 10817; 10818; 10831; 10832; 10845; 10846; 10859; 10860; 10873; 10874; 10887; 10888; 10609; 10610; 10623; 10624; 10637; 10638; 10651; 10652; 10665; 10666; 10679; 10680; 10693; 10694; 10707; 10708; 10721; 10722; 10735; 10736; 10749; 10750; 10763; 10764; 10777; 10778; 10791; 10792; 10805; 10806; 10819; 10820; 10833; 10834; 10847; 10848; 10861; 10862; 10875; 10876; 10889; 10890; 10611; 10612; 10625; 10626; 10639; 10640; 10653; 10654; 10667; 10668; 10681; 10682; 10695; 10696; 10709; 10710; 10723; 10724; 10737; 10738; 10751; 10752; 10765; 10766; 10779; 10780; 10793; 10794; 10807; 10808; 10821; 10822; 10835; 10836; 10849; 10850; 10863; 10864; 10877; 10878; 10891; 10892; 9304-9305; 9320-9321; 9336-9337; 9352-9353; 9368-9369; 9384-9385; 9400-9401; 9416-9417; 9432-9433; 9448-9449; 9464-9465; 9480-9481; 9496-9497; 9608-9609; 9720-9721; 9832-9833; 9944-9945; 10056-10057; 10168-10169; 10280-10281; 10392-10393; 10408; 10415; 10422; 10429; 10436; 10443; 10450; 10457; 10464; 10471; 10478; 10485; 10492; 10499; 10506; 10513; 10520; 10527; 10534; 10541; 10548; or a (functional) homolog, variant, fragment or derivative thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

In another preferred embodiment, the inventive artificial nucleic acid molecule may comprise a coding sequence comprising or consisting of a nucleic acid sequence encoding a Cpf1 protein as defined herein, wherein said nucleic acid sequence is defined by any one of SEQ ID NO: 10549 (i.e. AsCpf1=32L4_AsCpf1(Hsopt)-NLS3-3×HA-tag_albumin7) or SEQ ID NO: 10550 (i.e. LbCpf1=32L4_LbCpf1 (Hsopt)-NLS3-3×HA-tag_albumin7); or a (functional) homolog, variant, fragment or derivative thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

In preferred embodiments, inventive artificial nucleic acids further encode, in their coding region, at least one nuclear localization signal. The nucleic acid sequence encoding the nuclear localization signal(s) is/are preferably fused to the nucleic aid encoding the Cpf1 protein, or its homolog, variant, fragment or derivative, as defined herein, so as to facilitate transport of said Cpf1 protein, or its homolog, variant, fragment or derivative, into the nucleus. In preferred embodiments, artificial nucleic acids thus comprise or consist of a nucleic acid sequence encoding a Cpf1 protein, or its homolog, fragment, variant or derivative, fused to at least one nuclear localization signal, said nucleic acid sequence preferably being defined by any one of SEQ ID NOs: 10551; 10581; 10593; 10584; 10587; 10590; 10593; 10596; 409; 2538; 410; 2539; 10551; 10581; 11973; 11974-11980; 1378; 3698; 4858; 6018; 7178; 8338; 1379; 3699; 4859; 6019; 7179; 8339; 10593; 10584; 10587; 10590; 10593; 10596; 11965; 11981; 11989; 11997; 12005; 12013; 11966-11972; 11982-11988; 11990-11996; 11998-12004; 12006-12012; 12014-12020 or s nucleic acid encoding any one of or a combination of SEQ ID NO:12021-14274, or a (functional) homolog, variant, fragment or derivative thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

Advantageously, nucleic acid sequences encoding CRISPR-associated proteins such as Cpf1, or their a homologs, variants, fragments or derivatives, are combined within the coding region of the artificial nucleic acid according to the invention with UTRs as defined herein, in order to preferably increase the expression of said encoded proteins. In preferred embodiments, artificial nucleic acids comprise or consist of a nucleic acid sequence encoding a Cpf1 protein, or a homolog, variant or fragment thereof, that are further fused to at least one nuclear localization signal, said nucleic acid sequence preferably being defined by any one of SEQ ID Nos: 3488-3489; 10396; 2328-2329; 10395; 4648-4649; 10397; 5808-5809; 10398; 6968-6969; 10399; 8128-8129; 10400; 9274-9287; 3504-3505; 3520-3521; 3536-3537; 3552-3553; 3568-3669; 3584-3585; 3600-3601; 3616-3617; 3632-3633; 3648-3649; 3664-3665; 3680-3681; 3696-3697; 9528-9529; 9640-9641; 9752-9753; 9864-9865; 9976-9977; 10088-10089; 10200-10201; 10312-10313; 10403; 10410; 10417; 10424; 10431; 10438; 10445; 10452; 10459; 10466; 10473; 10480; 10487; 10494; 10501; 10508; 10515; 10522; 10529; 10536; 10543; 2344-2345; 2360-2361; 2376-2377; 2392-2393; 2408-2409; 2424-2425; 2440-2441; 2456-2457; 2472-2473; 2489-2490; 2504-2505; 2520-2521; 2536-2537; 9512-9513; 9624-9625; 9736-9737; 9848-9849; 9960-9961; 10072-10073; 10184-10185; 10296-10297; 10402; 10409; 10416; 10423; 10430; 10437; 10444; 10451; 10458; 10465; 10472; 10479; 10486; 10493; 10500; 10507; 10514; 10521; 10528; 10535; 10542; 4664-4665; 4680-4681; 4696-4697; 4712-4713; 4728-4729; 4744-4745; 4760-4761; 4776-4777; 4792-4793; 4808-4809; 4824-4825; 4840-4841; 4856-4857; 9544-9545; 9656-9657; 9768-9769; 9880-9881; 9992-9993; 10104-10105; 10216-10217; 10328-10329; 10404; 10411; 10418; 10425; 10432; 10439; 10446; 10453; 10460; 10467; 10474; 10481; 10488; 10495; 10502; 10509; 10516; 10523; 10530; 10537; 10544; 5824-5825; 5840-5841; 5856-5857; 5872-5873; 5888-5889; 5904-5905; 5920-5921; 5936-5937; 5952-5953; 5968-5969; 5984-5985; 6000-6001; 6016-6017; 9560-9561; 9672-9673; 9784-9785; 9896-9897; 10008-10009; 10120-10121; 10232-10233; 10344-10345; 10405; 10412; 10419; 10426; 10433; 10440; 10447; 10454; 10461; 10468; 10475; 10482; 10489; 10496; 10503; 10510; 10517; 10524; 10531; 10538; 10545; 7033; 7048-7049; 7064-7065; 7080-7081; 7096-7097; 7112-7113; 7128-7129; 7144-7145; 7160-7161; 7176-7177; 9576-9577; 9688-9689; 9800-9801; 9912-9913; 10024-10025; 10136-10137; 10248-10249; 10360-10361; 10406; 10413; 10420; 10427; 10434; 10441; 10448; 10455; 10462; 10469; 10476; 10483; 10490; 10497; 10504; 10511; 10518; 10525; 10532; 10539; 10546; 8144-8145; 8160-8160; 8176-8177; 8192-8193; 8208-8209; 8224-8225; 8240-8241; 8256-8257; 8272-8273; 8288-8289; 8304-8305; 8320-8321; 8336-8337; 9592-9593; 9704-9705; 9816-9817; 9928-9929; 10040-10041; 10152-10153; 10264-10265; 10376-10377; 10407; 10414; 10421; 10428; 10435; 10442; 10449; 10456; 10463; 10470; 10477; 10484; 10491; 10498; 10505; 10512; 10519; 10526; 10533; 10540; 10547; 9288-9289; 10401; 10553; 10582-10583 10579-10580; 10585-10586; 10588-10589; 10591-10592; 10594-10595; 10597-10598; 10554-10574; 10601; 10602; 10615; 10616; 10629; 10630; 10643; 10644; 10657; 10658; 10671; 10672; 10685; 10686; 10699; 10700; 10713; 10714; 10727; 10728; 10741; 10742; 10755; 10756; 10769; 10770; 10783; 10784; 10797; 10798; 10811; 10812; 10825; 10826; 10839; 10840; 10853; 10854; 10867; 10868; 10881; 10882 10603; 10604; 10617; 10618; 10631; 10632; 10645; 10646; 10659; 10660; 10673; 10674; 10687; 10688; 10701; 10702; 10715; 10716; 10729; 10730; 10743; 10744; 10757; 10758; 10771; 10772; 10785; 10786; 10799; 10800; 10813; 10814; 10827; 10828; 10841; 10842; 10855; 10856; 10869; 10870; 10883; 10884; 10605; 10606; 10619; 10620; 10633; 10634; 10647; 10648; 10661; 10662; 10675; 10676; 10689; 10690; 10703; 10704; 10717; 10718; 10731; 10732; 10745; 10746; 10759; 10760; 10773; 10774; 10787; 10788; 10801; 10802; 10815; 10816; 10829; 10830; 10843; 10844; 10857; 10858; 10871; 10872; 10885; 10886; 10607; 10608; 10621; 10622; 10635; 10636; 10649; 10650; 10663; 10664; 10677; 10678; 10691; 10692; 10705; 10706; 10719; 10720; 10733; 10734; 10747; 10748; 10761; 10762; 10775; 10776; 10789; 10790; 10803; 10804; 10817; 10818; 10831; 10832; 10845; 10846; 10859; 10860; 10873; 10874; 10887; 10888; 10609; 10610; 10623; 10624; 10637; 10638; 10651; 10652; 10665; 10666; 10679; 10680; 10693; 10694; 10707; 10708; 10721; 10722; 10735; 10736; 10749; 10750; 10763; 10764; 10777; 10778; 10791; 10792; 10805; 10806; 10819; 10820; 10833; 10834; 10847; 10848; 10861; 10862; 10875; 10876; 10889; 10890; 10611; 10612; 10625; 10626; 10639; 10640; 10653; 10654; 10667; 10668; 10681; 10682; 10695; 10696; 10709; 10710; 10723; 10724; 10737; 10738; 10751; 10752; 10765; 10766; 10779; 10780; 10793; 10794; 10807; 10808; 10821; 10822; 10835; 10836; 10849; 10850; 10863; 10864; 10877; 10878; 10891; 10892; 9304-9305; 9320-9321; 9336-9337; 9352-9353; 9368-9369; 9384-9385; 9400-9401; 9416-9417; 9432-9433; 9448-9449; 9464-9465; 9480-9481; 9496-9497; 9608-9609; 9720-9721; 9832-9833; 9944-9945; 10056-10057; 10168-10169; 10280-10281; 10392-10393; 10408; 10415; 10422; 10429; 10436; 10443; 10450; 10457; 10464; 10471; 10478; 10485; 10492; 10499; 10506; 10513; 10520; 10527; 10534; 10541; 10548, or a (functional) homolog, variant, fragment or derivative thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any one of these sequences.

Advantageously, any Cpf1 sequence as disclosed can be selected for the inventive use i.e. any sequence as mentioned above i.e. as disclosed herein and/or in the sequence listing, i.e. Cpf1 protein sequences and mRNAs encoding different versions of the respective Cpf1 protein sequences i.e. WT or optimized sequences.

In further embodiments, the artificial nucleic acid sequences according to the invention may comprise or consist of a nucleic acid sequence according to SEQ ID NOs: 2298-2299; 3458-3459; 4618-4619; 5778-5779; 6938-6939; 8098-8099; 9258-9259; 2300-2313; 3460-3473; 4620-4633; 5780-5793; 6940-6953; 8100-8113; 9260-9273; 2328-2329; 10395; 3488-3489; 10396; 4648-4649; 10397; 5808-5809; 10398; 6968-6969; 10399; 8128-8129; 10400; 9288-9289; 10401; 2344-2345; 2360-2361; 2376-2377; 2392-2393; 2408-2409; 2424-2425; 2440-2441; 2456-2457; 2472-2473; 2489-2490; 2504-2505; 2520-2521; 2536-2537; 9512-9513; 9624-9625; 9736-9737; 9848-9849; 9960-9961; 10072-10073; 10184-10185; 10296-10297; 10402; 10409; 10416; 10423; 10430; 10437; 10444; 10451; 10458; 10465; 10472; 10479; 10486; 10493; 10500; 10507; 10514; 10521; 10528; 10535; 10542; 3504-3505; 3520-3521; 3536-3537; 3552-3553; 3568-3669; 3584-3585; 3600-3601; 3616-3617; 3632-3633; 3648-3649; 3664-3665; 3680-3681; 3696-3697; 9528-9529; 9640-9641; 9752-9753; 9864-9865; 9976-9977; 10088-10089; 10200-10201; 10312-10313; 10403; 10410; 10417; 10424; 10431; 10438; 10445; 10452; 10459; 10466; 10473; 10480; 10487; 10494; 10501; 10508; 10515; 10522; 10529; 10536; 10543; 4664-4665; 4680-4681; 4696-4697; 4712-4713; 4728-4729; 4744-4745; 4760-4761; 4776-4777; 4792-4793; 4808-4809; 4824-4825; 4840-4841; 4856-4857; 9544-9545; 9656-9657; 9768-9769; 9880-9881; 9992-9993; 10104-10105; 10216-10217; 10328-10329; 10404; 10411; 10418; 10425; 10432; 10439; 10446; 10453; 10460; 10467; 10474; 10481; 10488; 10495; 10502; 10509; 10516; 10523; 10530; 10537; 10544; 5824-5825; 5840-5841; 5856-5857; 5872-5873; 5888-5889; 5904-5905; 5920-5921; 5936-5937; 5952-5953; 5968-5969; 5984-5985; 6000-6001; 6016-6017; 9560-9561; 9672-9673; 9784-9785; 9896-9897; 10008-10009; 10120-10121; 10232-10233; 10344-10345; 10405; 10412; 10419; 10426; 10433; 10440; 10447; 10454; 10461; 10468; 10475; 10482; 10489; 10496; 10503; 10510; 10517; 10524; 10531; 10538; 10545; 6984-6985; 7000-7001; 1016-7017; 7032-7033; 7048-7049; 7064-7065; 7080-7081; 7096-7097; 7112-7113; 7128-7129; 7144-7145; 7160-7161; 7176-7177; 9576-9577; 9688-9689; 9800-9801; 9912-9913; 10024-10025; 10136-10137; 10248-10249; 10360-10361; 10406; 10413; 10420; 10427; 10434; 10441; 10448; 10455; 10462; 10469; 10476; 10483; 10490; 10497; 10504; 10511; 10518; 10525; 10532; 10539; 10546; 8144-8145; 8160-8160; 8176-8177; 8192-8193; 8208-8209; 8224-8225; 8240-8241; 8256-8257; 8272-8273; 8288-8289; 8304-8305; 8320-8321; 8336-8337; 9592-9593; 9704-9705; 9816-9817; 9928-9929; 10040-10041; 10152-10153; 10264-10265; 10376-10377; 10407; 10414; 10421; 10428; 10435; 10442; 10449; 10456; 10463; 10470; 10477; 10484; 10491; 10498; 10505; 10512; 10519; 10526; 10533; 10540; 10547; 9304-9305; 9320-9321; 9336-9337; 9352-9353; 9368-9369; 9384-9385; 9400-9401; 9416-9417; 9432-9433; 9448-9449; 9464-9465; 9480-9481; 9496-9497; 9608-9609; 9720-9721; 9832-9833; 9944-9945; 10056-10057; 10168-10169; 10280-10281; 10392-10393; 10408; 10415; 10422; 10429; 10436; 10443; 10450; 10457; 10464; 10471; 10478; 10485; 10492; 10499; 10506; 10513; 10520; 10527; 10534; 10541; 10548; 10552; 10594-10595; 10582-10583; 10585-10586; 10588-10589; 10591-10592; 10594-10595; 10597-10598; 10553; 10599; 10600; 10613; 10614; 10627; 10628; 10641; 10642; 10655; 10656; 10669; 10670; 10683; 10684; 10697; 10698; 10711; 10712; 10725; 10726; 10739; 10740; 10753; 10754; 10767; 10768; 10781; 10782; 10795; 10796; 10809; 10810; 10823; 10824; 10837; 10838; 10851; 10852; 10865; 10866; 10879; 10880; 10601; 10602; 10615; 10616; 10629; 10630; 10643; 10644; 10657; 10658; 10671; 10672; 10685; 10686; 10699; 10700; 10713; 10714; 10727; 10728; 10741; 10742; 10755; 10756; 10769; 10770; 10783; 10784; 10797; 10798; 40811; 10812; 10825; 10826; 10839; 10840; 10853; 10854; 10867; 10868; 10881; 10882; 10603; 10604; 10617; 10618; 10631; 10632; 10645; 10646; 10659; 10660; 10673; 10674; 10687; 10688; 10701; 10702; 10715; 10716; 10729; 10730; 10743; 10744; 10757; 10758; 10771; 10772; 10785; 10786; 10799; 10800; 10813; 10814; 10827; 10828; 10841; 10842; 10855; 10856; 10869; 10870; 10883; 10884; 10605; 10606; 10619; 10620; 10633; 10634; 10647; 10648; 10661; 10662; 10675; 10676; 10689; 10690; 10703; 10704; 10717; 10718; 10731; 10732; 10745; 10746; 10759; 10760; 10773; 10774; 10787; 10788; 10801; 10802; 10815; 10816; 10829; 10830; 10843; 10844; 10857; 10858; 10871; 10872; 10885; 10886; 10607; 10608; 10621; 10622; 10635; 10636; 10649; 10650; 10663; 10664; 10677; 10678; 10691; 10692; 10705; 10706; 10719; 10720; 10733; 10734; 10747; 10748; 10761; 10762; 10775; 10776; 10789; 10790; 10803; 10804; 10817; 10818; 10831; 10832; 10845; 10846; 10859; 10860; 10873; 10874; 10887; 10888; 10609; 10610; 10623; 10624; 10637; 10638; 10651; 10652; 10665; 10666; 10679; 10680; 10693; 10694; 10707; 10708; 10721; 10722; 10735; 10736; 10749; 10750; 10763; 10764; 10777; 10778; 10791; 10792; 10805; 10806; 10819; 10820; 10833; 10834; 10847; 10848; 10861; 10862; 10875; 10876; 10889; 10890; 10611; 10612; 10625; 10626; 10639; 10640; 10653; 10654; 10667; 10668; 10681; 10682; 10695; 10696; 10709; 10710; 10723; 10724; 10737; 10738; 10751; 10752; 10765; 10766; 10779; 10780; 10793; 10794; 10807; 10808; 10821; 10822; 10835; 10836; 10849; 10850; 10863; 10864; 10877; 10878; 10891; 10892; 2298-2299; 3458-3459; 4618-4619; 5778-5779; 6938-6939; 8098-8099; 9258-9259; 10552; 2300-2313; 3460-3473; 4620-4633; 5780-5793; 6940-6953; 8100-8113; 9260-9273; 2314-2327; 3474-3887; 4634-4647; 5794-5807; 6954-6967; 8114-8127; 9274-9287; 2328-2329; 10395; 3488-3489; 10396; 4648-4649; 10397; 5808-5809; 10398; 6968-6969; 10399; 8128-8129; 10400; 9288-9289; 10401; 10553; 2344-2345; 2360-2361; 2376-2377; 2392-2393; 2408-2409; 2424-2425; 2440-2441; 2456-2457; 2472-2473; 2489-2490; 2504-2505; 2520-2521; 2536-2537; 9512-9513; 9624-9625; 9736-9737; 9848-9849; 9960-9961; 10072-10073; 10184-10185; 10296-10297; 10402; 10409; 10416; 10423; 10430; 10437; 10444; 10451; 10458; 10465; 10472; 10479; 10486; 10493; 10500; 10507; 10514; 10521; 10528; 10535; 10542; 3504-3505; 3520-3521; 3536-3537; 3552-3553; 3568-3669; 3584-3585; 3600-3601; 3616-3617; 3632-3633; 3648-3649; 3664-3665; 3680-3681; 3696-3697; 9528-9529; 9640-9641; 9752-9753; 9864-9865; 9976-9977; 10088-10089; 10200-10201; 10312-10313; 10403; 10410; 10417; 10424; 10431; 10438; 10445; 10452; 10459; 10466; 10473; 10480; 10487; 10494; 10501; 10508; 10515; 10522; 10529; 10536; 10543; 4664-4665; 4680-4681; 4696-4697; 4712-4713; 4728-4729; 4744-4745; 4760-4761; 4776-4777; 4792-4793; 4808-4809; 4824-4825; 4840-4841; 4856-4857; 9544-9545; 9656-9657; 9768-9769; 9880-9881; 9992-9993; 10104-10105; 10216-

10217; 10328-10329; 10404; 10411; 10418; 10425; 10432; 10439; 10446; 10453; 10460; 10467; 10474; 10481; 10488; 10495; 10502; 10509; 10516; 10523; 10530; 10537; 10544; 5824-5825; 5840-5841; 5856-5857; 5872-5873; 5888-5889; 5904-5905; 5920-5921; 5936-5937; 5952-5953; 5968-5969; 5984-5985; 6000-6001; 6016-6017; 9560-9561; 9672-9673; 9784-9785; 9896-9897; 10008-10009; 10120-10121; 10232-10233; 10344-10345; 10405; 10412; 10419; 10426; 10433; 10440; 10447; 10454; 10461; 10468; 10475; 10482; 10489; 10496; 10503; 10510; 10517; 10524; 10531; 10538; 10545; 6984-6985; 7000-7001; 1016-7017; 7032-7033; 7048-7049; 7064-7065; 7080-7081; 7096-7097; 7112-7113; 7128-7129; 7144-7145; 7160-7161; 7176-7177; 9576-9577; 9688-9689; 9800-9801; 9912-9913; 10024-10025; 10136-10137; 10248-10249; 10360-10361; 10406; 10413; 10420; 10427; 10434; 10441; 10448; 10455; 10462; 10469; 10476; 10483; 10490; 10497; 10504; 10511; 10518; 10525; 10532; 10539; 10546; 8144-8145; 8160-8160; 8176-8177; 8192-8193; 8208-8209; 8224-8225; 8240-8241; 8256-8257; 8272-8273; 8288-8289; 8304-8305; 8320-8321; 8336-8337; 9592-9593; 9704-9705; 9816-9817; 9928-9929; 10040-10041; 10152-10153; 10264-10265; 10376-10377; 10407; 10414; 10421; 10428; 10435; 10442; 10449; 10456; 10463; 10470; 10477; 10484; 10491; 10498; 10505; 10512; 10519; 10526; 10533; 10540; 10547; 9304-9305; 9320-9321; 9336-9337; 9352-9353; 9368-9369; 9384-9385; 9400-9401; 9416-9417; 9432-9433; 9448-9449; 9464-9465; 9480-9481; 9496-9497; 9608-9609; 9720-9721; 9832-9833; 9944-9945; 10056-10057; 10168-10169; 10280-10281; 10392-10393; 10408; 10415; 10422; 10429; 10436; 10443; 10450; 10457; 10464; 10471; 10478; 10485; 10492; 10499; 10506; 10513; 10520; 10527; 10534; 10541; 10548; 10554-10574; 10594-10595; 10582-10583; 10585-10586; 10588-10589; 10591-10592; 10594-10595; 10597-10598; 10599; 10600; 10613; 10614; 10627; 10628; 10641; 10642; 10655; 10656; 10669; 10670; 10683; 10684; 10697; 10698; 10711; 10712; 10725; 10726; 10739; 10740; 10753; 10754; 10767; 10768; 10781; 10782; 10795; 10796; 10809; 10810; 10823; 10824; 10837; 10838; 10851; 10852; 10865; 10866; 10879; 10880; 10601; 10602; 10615; 10616; 10629; 10630; 10643; 10644; 10657; 10658; 10671; 10672; 10685; 10686; 10699; 10700; 10713; 10714; 10727; 10728; 10741; 10742; 10755; 10756; 10769; 10770; 10783; 10784; 10797; 10798; 10811; 10812; 10825; 10826; 10839; 10840; 10853; 10854; 10867; 10868; 10881; 10882; 10603; 10604; 10617; 10618; 10631; 10632; 10645; 10646; 10659; 10660; 10673; 10674; 10687; 10688; 10701; 10702; 10715; 10716; 10729; 10730; 10743; 10744; 10757; 10758; 10771; 10772; 10785; 10786; 10799; 10800; 10813; 10814; 10827; 10828; 10841; 10842; 10855; 10856; 10869; 10870; 10883; 10884; 10605; 10606; 10619; 10620; 10633; 10634; 10647; 10648; 10661; 10662; 10675; 10676; 10689; 10690; 10703; 10704; 10717; 10718; 10731; 10732; 10745; 10746; 10759; 10760; 10773; 10774; 10787; 10788; 10801; 10802; 10815; 10816; 10829; 10830; 10843; 10844; 10857; 10858; 10871; 10872; 10885; 10886; 10607; 10608; 10621; 10622; 10635; 10636; 10649; 10650; 10663; 10664; 10677; 10678; 10691; 10692; 10705; 10706; 10719; 10720; 10733; 10734; 10747; 10748; 10761; 10762; 10775; 10776; 10789; 10790; 10803; 10804; 10817; 10818; 10831; 10832; 10845; 10846; 10859; 10860; 10873; 10874; 10887; 10888; 10609; 10610; 10623; 10624; 10637; 10638; 10651; 10652; 10665; 10666; 10679; 10680; 10693; 10694; 10707; 10708; 10721; 10722; 10735; 10736; 10749; 10750; 10763; 10764; 10777; 10778; 10791; 10792; 10805; 10806; 10819; 10820; 10833; 10834; 10847; 10848; 10861; 10862; 10875; 10876; 10889; 10890; 10611; 10612; 10625; 10626; 10639; 10640; 10653; 10654; 10667; 10668; 10681; 10682; 10695; 10696; 10709; 10710; 10723; 10724; 10737; 10738; 10751; 10752; 10765; 10766; 10779; 10780; 10793; 10794; 10807; 10808; 10821; 10822; 10835; 10836; 10849; 10850; 10863; 10864; 10877; 10878; 10891; 10892 of PCT/EP2017/076775, or (functional) homologs, fragments, variants or derivatives thereof.

Cas13, CasX, CasY and Other (Endo)Nucleases

Amino Acid Sequences

Several Cas13, CasX and CasY proteins are known in the art and are envisaged as CRISPR-associated proteins in the context of the present invention. Suitable Cas13, CasX and CasY proteins are shown under SEQ ID NO: 10893-10925; 10926-10998 (Cas13 i.e. WP15770004, WP18451595, WP21744063, WP21746774, ERK53440, WP31473346, CVRQ01000008, CRZ35554, WP22785443, WP36091002, WP12985477, WP13443710, ETD76934, WP38617242, WP2664492, WP4343973, WP44065294, ADAR2DD, WP47447901, ERI81700, WP34542281, WP13997271, WP41989581, WP47431796, WP14084666, WP60381855, WP14165541, WP63744070, WP65213424, WP45968377, EH006562, WP6261414, EKB06014, WP58700060, WP13446107, WP44218239, WP12458151, ER381987, ER365637, WP21665475, WP61156637, WP23846767, ER387335, WP5873511, WP39445055, WP52912312, WP53444417, WP12458414, WP39417390, EOA10535, WP61156470, WP13816155, WP5874195, WP39437199, WP39419792, WP39431778, WP46201018, WP39442171, WP39426176, WP39418912, WP39434803, WP39428968, WP25000926, EFU31981, WP4343581, WP36884929, BAU18623, AF307523, WP14708441, WP36860899, WP61868553, KJ386756, EGQ18444, EKY00089, WP36929175, WP7412163, WP44072147, WP42518169, WP44074780, WP15024765, WP49354263, WP4919755, WP64970887, WP61710138); 11002; 11003 (CasX i.e. OGP07438, OHB99618); and 11004-11010 (CasY i.e. 03108769, OGY82221, 03106454, APG80656, 03107455, 03109436, PIP58309).

Advantageously, nucleic acid sequences encoding CRISPR-associated proteins such as Cas13, or their a homologs, variants, fragments or derivatives, are combined within the coding region of the artificial nucleic acid according to the invention with UTRs as defined herein, in order to preferably increase the expression of said encoded proteins. In preferred embodiments, artificial nucleic acids comprise or consist of a nucleic acid sequence encoding a Cas13 protein, or a homolog, variant or fragment thereof, that are further fused to at least one nuclear localization signal, said nucleic acid sequence preferably being defined by any one of SEQ ID NO: 11011-11042; 11249-11280; 11044-11116; 11282-11354; 11131-11162; 11367-11398; 11485-11516; 11603-11634; 11721-11752; 11839-11870; 11164-11236; 11400-11472; 11518-11590; 11636-11708; 11754-11826; 11872-11944 or a (functional) homolog, variant, fragment or derivative thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any one of these sequences. Also other Cas13 proteins are comprised within the disclosure of the invention, i.e. Cas13a, Cas13b, Cas13c and Cas13d (as apparent from PMID 29551514 and 29551272, herein incorporated by reference). Also incorporated herein by reference are the Cas13 related publications PMID 26593719, 28976959, and 29070703.

A large number of Cas13 proteins are known in the art and are envisaged as CRISPR-associated proteins in the context of the present invention. Preferred Cas13d sequences of the invention are Cas13d Protein (SEQ ID NO:14294-14321) and their optimized mRNA sequences having SEQ ID NO:14322-14349, SEQ ID NO:14350-14377, SEQ ID NO:14378-14405, SEQ ID NO:14406-14433, SEQ ID NO:14434-14461, SEQ ID NO:14462-14489, and SEQ ID NO:14490-14517.

Advantageously, nucleic acid sequences encoding CRISPR-associated proteins such as CasX, or their a homologs, variants, fragments or derivatives, are combined within the coding region of the artificial nucleic acid according to the invention with UTRs as defined herein, in order to preferably increase the expression of said encoded proteins. In preferred embodiments, artificial nucleic acids comprise or consist of a nucleic acid sequence encoding a CasX protein, or a homolog, variant or fragment thereof, that are further fused to at least one nuclear localization signal, said nucleic acid sequence preferably being defined by any one of SEQ ID NO: 11120-11122; 11240; 11241; 11358; 11359; 11476; 11477; 11594; 11595; 11712; 11713; 11830; 11831; 11948; 11949 or a (functional) homolog, variant, fragment or derivative thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any one of these sequences.

Advantageously, any Cas13, CasX or CasY sequence as disclosed herein or in the sequence listing can be selected for the inventive use as CRISPR-associated proteins in the context of the present invention i.e. any sequence as mentioned above i.e. as disclosed herein and/or in the sequence listing, i.e. Cas13, CasX or CasY protein sequences and mRNAs encoding different versions of the respective Cas13, CasX or CasY protein sequences i.e. WT or optimized sequences.

Further, adenine base editors (ABEs) that mediate the conversion of A•T to G•C in genomic DNA as described in PMID 29160308 are incorporated herein by reference as well as the publication PMID 29160308 itself. According to the authors, ABEs introduce point mutations more efficiently and cleanly, and with less off-target genome modification, than a current Cas9 nuclease-based method, and can install disease-correcting or disease-suppressing mutations in human cells.

ARMAN Endonucleases

Also the use new CRISPR-Cas systems from uncultivated microbes, i.e. ARMAN Cas9, i.e. nanoarchaea ARMAN-1 (*Candidatus* Micrarchaeum *acidiphilum* ARMAN-1) and ARMAN-4 (*Candidatus* Parvarchaeum *acidiphilum* ARMAN-4), is comprised within the teaching of the invention by reference to PMID 28005056, 20421484 and 17185602 which are incorporated herein by reference.

Advantageously, nucleic acid sequences encoding CRISPR-associated proteins such as CasY, or their a homologs, variants, fragments or derivatives, are combined within the coding region of the artificial nucleic acid according to the invention with UTRs as defined herein, in order to preferably increase the expression of said encoded proteins. In preferred embodiments, artificial nucleic acids comprise or consist of a nucleic acid sequence encoding a CasY protein, or a homolog, variant or fragment thereof, that are further fused to at least one nuclear localization signal, said nucleic acid sequence preferably being defined by any one of SEQ ID NO: 11123-11130; 11360-11366; 11242-11248; 11478-11484; 11596-11602; 11714-11720; 11832-11838; 11950-11956 or a (functional) homolog, variant, fragment or derivative thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any one of these sequences.

gRNAs

As discussed herein, a functional CRISPR-Cas system typically requires the presence of a guide RNA ("gRNA") that associates with and recruits a CRISPR-associated protein to a complementary target DNA sequence. The structure and characteristics of the guide RNA typically depend on the choice of the particular CRISPR-associated protein.

As used herein, the term "guide RNA" thus relates to any RNA molecule capable of targeting a CRISPR-associated protein to a target DNA sequence of interest. Guide RNAs (gRNAs) preferably comprise a i) first region of complementarity that is capable of specifically hybridizing with a target DNA sequence and ii) a second region that interacts with a CRISPR-associated protein.

Said region, which is typically located at the 5' end of the gRNA, comprising a short nucleotide sequence that is complementary to a target DNA sequence, and is also referred to herein as a "targeting region". The term "region" refers to a section/segment of a molecule, e.g., a contiguous stretch of nucleotides in an RNA. The targeting region may be about 17-20, e.g. about 21-23 nucleotides, in length or may longer or shorter ("truncated gRNA"). It may preferably interact with the target DNA sequence through hydrogen bonding between complementary base pairs (i.e., paired bases).

The "gRNA" can be of any length, provided that it comprises a "targeting region" and is preferably capable of recruiting a CRISPR-associated protein to a target DNA sequence in a sequence-specific manner. Therefore, "gRNAs" may be at least 10, at least 11, at least 12, more preferably at least 13, at least 14, at least 15, and most preferably at least 16 or at least 17 nucleotides or at least 18 nucleotides or at least 19 nucleotides or at least 20 nucleotides in length. In some embodiments, the "gRNA" comprises a targeting region which is preferably at least 21, at least 22, at least 23, at least 24, at least 25 nucleotides or more in length and ii) a second region that interacts with a CRISPR-associated protein.

As used herein, the term "gRNA" includes two-molecule gRNAs as well as single-molecule RNAs. The gRNA may or may not comprise secondary structure features for interacting with the CRISPR-associated protein.

The type II CRISPR-Cas9 system naturally employs two-molecule gRNAs. Such two-molecule gRNAs ("tracrRNA/crRNA") typically comprises a crRNA ("CRISPR RNA" or "targeter-RNA" or "crRNA" or "crRNA repeat") and a corresponding tracrRNA ("trans-acting CRISPR RNA" or "activator-RNA" or "tracrRNA") molecule. A crRNA comprises both the targeting region (single stranded) and a stretch ("duplex-forming region") of nucleotides that forms one half of the dsRNA duplex of the Cas9-binding region of the gRNA. A corresponding tracrRNA comprises a stretch of nucleotides (duplex-forming region) that forms the other half of the dsRNA duplex of the Cas9-binding region of the gRNA. In other words, a stretch of nucleotides of a crRNA are complementary to and hybridize with a stretch of nucleotides of a tracrRNA to form the dsRNA duplex of the Cas9-binding region of the gRNA. As such, each crRNA can be said to have a corresponding tracrRNA. The crRNA additionally provides the single stranded targeting region. Thus, a crRNA and a tracrRNA (as a corresponding pair) hybridize to form a gRNA.

The crRNA and tracrRNA can also be joined to provide an (artificial) single-molecule guide RNAs ("single-guide RNAs", "sgRNAs"). An "sgRNA" typically comprises a crRNA connected at its 3' end to the 5' end of a tracrRNA through a "loop" sequence (see, e.g., U.S. Patent Application No. US20140068797). Similar to crRNA, sgRNA comprises a targeting region of complementarity to a target polynucleotide sequence, typically adjacent a second region that forms base-pair hydrogen bonds that form a secondary structure, typically a stem structure. "sgRNAs" are typically ~100 nucleotides in length, however, the term also includes truncated single-guide RNAs (tru-sgRNAs) of approximately 17-18 nt (cf. Fu, Y. et. al. Nat Biotechnol. 2014 March; 32(3):279-84). The term also encompasses functional miniature sgRNAs with expendable features removed, which retain an essential and conserved module termed the "nexus" located in the portion of sgRNA that corresponds to tracrRNA (not crRNA) (cf. U.S. Patent Application No. 20140315985 and Briner A E et al. Mol Cell. 2014 Oct. 23; 56(2):333-9). The nexus is located immediately downstream of (i.e., located in the 3' direction from) the lower stem in Type II CRISPR-Cas9 systems. The term "sgRNA" also encompasses "deadRNAs" ("dRNAs") comprising shortened targeting regions of 11-15 nucleotides. Such dRNAs can be used to recruit catalytically active Cas9 endonucleases to target DNA sequences for altering gene expression without inducing DSBs (cf. Dahlman J E et al. Nat Biotechnol. 2015 November; 33(11):1159-61). sgRNA derivatives are also comprised by the term. Such derivatives typically include further moieties or entities conferring a new or additional functionality. Particularly, MS2 aptamers added to sgRNA tetraloop and/or stem-loop structures are capable of selectively recruiting effector proteins comprising said MS2 domains to the target DNA ("sgRNA-MS2") (cf. Konermann S et al. Nature. 2015 Jan. 29; 517(7536): 583-588). Further modifications are also conceivable and envisaged herein.

The use of tracrRNA/crRNA or sgRNAs as gRNAs is not limited to Cas9 proteins. Any other CRISPR-associated system, preferably of the type II CRISPR-Cas system, may be used in connection with such gRNAs. However, other gRNAs may be required to ensure functionality of other CRISPR-Cas proteins, and such gRNAs are also encompassed in the respective definition. For instance, type V CRISPR-associated proteins, such as Cpf1, is guided by a single and short (42-44 nt) crRNA as a gRNA, typically comprising single stem loop in a direct repeat sequence.

gRNAs, such as tracrRNA/crRNA, sgRNAs or crRNAs may be provided by any suitable means, e.g. in naked or complexed form as described herein in the context of artificial nucleic acid molecules, e.g. using lipids or (poly-) cationic carriers, but are typically delivered by a vector. Suitable vectors (as defined in the section headed "Definitions") include any nucleic acid, that is capable of preferably ubiquitously expressing functional gRNAs (i.e. which are capable of recruiting the respective CRISPR-associated protein to the target DNA sequence). Vectors therefore include plasmids and viral vectors, in particular lentiviral vectors and adeno-associated virus vectors (AAV).

RNAs

The inventive artificial nucleic acid molecule may preferably be an RNA. It will be understood that the term "RNA" refers to ribonucleic acid molecules characterized by the specific succession of their nucleotides joined to form said molecules (i.e. their RNA sequence). The term "RNA" may thus be used to refer to RNA molecules or RNA sequences as will be readily understood by the skilled person in the respective context. For instance, the term "RNA" as used in the context of the invention preferably refers to an RNA molecule (said molecule being characterized, inter alia, by its particular RNA sequence). The term "RNA" in the context of sequence modifications will be understood to relate to modified RNA sequences, but typically also includes the resulting RNA molecules (which are modified with regard to their RNA sequence). In preferred embodiments, the RNA may be an mRNA, a viral RNA or a replicon RNA, preferably an mRNA.

Mono-, Bi- or Multicistronic RNAs

According to some embodiments of the present invention, the artificial nucleic acid molecule, preferably RNA, may mono-, bi-, or multicistronic, preferably as defined herein. Bi- or multicistronic RNAs typically comprise two (bicistronic) or more (multicistronic) open reading frames (ORF). An open reading frame in this context is a sequence of codons that is translatable into a peptide or protein. The coding sequences in a bi- or multicistronic artificial nucleic acid molecule, preferably RNA, preferably encode distinct proteins as defined herein. Bi- or even multicistronic artificial nucleic acid molecule, preferably RNAs, may encode, for example, at least two, three, four, five, six or more (preferably different) proteins (or homologs, variants, fragments or derivatives thereof) as defined herein. The term "encoding two or more proteins" may mean, without being limited thereto, that the bi- or even multicistronic artificial nucleic acid molecule, preferably RNA, may encode e.g. at least two, three, four, five, six or more (preferably different) proteins (or homologs, variants, fragments or derivatives thereof).

In some embodiments, the coding sequences encoding two or more CRISPR-associated proteins, or homologs, variants, fragments or derivatives thereof as defined herein, may be separated in the bi- or multicistronic RNA by at least one IRES (internal ribosomal entry site) sequence. The term "IRES" (internal ribosomal entry site) refers to an RNA sequence that allows for translation initiation. An IRES can function as a sole ribosome binding site, but it can also serve to provide a bi- or even multicistronic artificial nucleic acid molecule, preferably RNA as defined above, which encodes several proteins (or homologs, variants, fragments or derivatives thereof), which are to be translated by the ribosomes independently of one another. Examples of IRES sequences, which can be used according to the invention, are those derived from picornaviruses (e.g. FMDV), pestiviruses (CFFV), polioviruses (PV), encephalomyocarditis viruses (ECMV), foot and mouth disease viruses (FMDV), hepatitis C viruses (HCV), classical swine fever viruses (CSFV), mouse leukoma virus (MLV), simian immunodeficiency viruses (SIV) or cricket paralysis viruses (CrPV).

According to further embodiments the at least one coding sequence of the artificial nucleic acid molecule, preferably RNA, of the invention may encode at least two, three, four, five, six, seven, eight and more CRISPR-associated proteins (or homologs, variants, fragments or derivatives thereof) as defined herein linked with or without an amino acid linker sequence, wherein said linker sequence may comprise rigid linkers, flexible linkers, cleavable linkers (e.g., self-cleaving peptides) or a combination thereof. Exemplary linkers are described in the section headed "Derivatives". The respective disclosure is applicable to the linkage of multiple CRISPR-associated proteins, *Mutatis mutandis*. Therein, CRISPR-associated proteins as defined herein may be identical or different or a combination thereof.

Preferably, the artificial nucleic acid molecule, preferably RNA, comprises a length of about 50 to about 20000, or 100 to about 20000 nucleotides, preferably of about 250 to about 20000 nucleotides, more preferably of about 500 to about 10000, even more preferably of about 500 to about 5000.

The artificial nucleic acid molecule, preferably RNA, of the invention may further be single stranded or double stranded. When provided as a double stranded RNA, the artificial nucleic acid molecule preferably comprises a sense and a corresponding antisense strand.

Nucleic Acid Modifications

Artificial nucleic acid molecules, preferably RNAs, of the invention, or any other nucleic acid defined herein (e.g. a vector), may be provided in the form of modified nucleic acids. Suitable nucleic acid modifications envisaged in the context of the present invention are described below. The expression "any other nucleic acid as defined herein" may, but typically does not, refer to gRNAs.

According to preferred embodiments, the at least one artificial nucleic acid molecule, preferably RNA (sequence) of the invention (or any other nucleic acid, in particular RNA, as defined herein), is modified as defined herein. A modification as defined herein preferably leads to a stabilization of said artificial nucleic acid molecule, preferably RNA. More preferably, the invention thus provides a "stabilized" artificial nucleic acid molecule, preferably RNA (or any other nucleic acid, in particular RNA, as defined herein).

According to preferred embodiments, the artificial nucleic acid molecule, preferably RNA, of the invention (or any other nucleic acid, in particular RNA, as defined herein) may thus be provided as a "stabilized" artificial nucleic acid molecule, preferably RNA, in particular mRNA, i.e. which is essentially resistant to in vivo degradation (e.g. by an exo- or endo-nuclease).

Such stabilization can be effected, for example, by a modified phosphate backbone of the artificial nucleic acid molecule, preferably RNA (or any other nucleic acid, in particular RNA, as defined herein). A backbone modification in connection with the present invention is a modification in which phosphates of the backbone of the nucleotides contained in said RNA (or any other nucleic acid, in particular RNA, as defined herein) are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized artificial nucleic acid molecule, preferably RNAs (or other nucleic acids, in particular RNAs, as defined herein) may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, which are preferably capable of "stabilizing" the artificial nucleic acid molecule, preferably RNA, of the invention (or any other nucleic acid, in particular RNA, as defined herein).

Chemical Modifications

The term "modification" as used herein may refer to chemical modifications comprising backbone modifications as well as sugar modifications or base modifications.

In this context, a "modified" artificial nucleic acid molecule, preferably RNA (or any other nucleic acid, in particular RNA, as defined herein) may contain nucleotide analogues/modifications (modified nucleotides or nucleosides), e.g. backbone modifications, sugar modifications or base modifications.

A backbone modification in connection with the present invention is a modification, in which phosphates of the backbone of the nucleotides contained in said artificial nucleic acid molecule, preferably RNA (or any other nucleic acid, in particular RNA, as defined herein) herein are chemically modified. A sugar modification in connection with the present invention is a chemical modification of the sugar of the nucleotides of the artificial nucleic acid molecule, preferably RNA (or any other nucleic acid, in particular RNA, as defined herein). Furthermore, a base modification in connection with the present invention is a chemical modification of the base moiety of the nucleotides of the artificial nucleic acid molecule, preferably RNA (or any other nucleic acid, in particular RNA, as defined herein). In this context, nucleotide analogues or modifications are preferably selected from nucleotide analogues, which are applicable for transcription and/or translation.

Sugar Modifications:

(Chemically) modified nucleic acids, in particular artificial nucleic acid molecules according to the invention, may comprise sugar modifications, i.e., nucleosides/nucleotides that are modified in their sugar moiety.

For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O(CH$_2$CH$_2$O)nCH$_2$CH$_2$OR; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. NH$_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, a modified artificial nucleic acid molecule, preferably RNA (or any other nucleic acid, in particular RNA, as defined herein) can include nucleotides containing, for instance, arabinose as the sugar.

Backbone Modifications:

(Chemically) modified nucleic acids, in particular artificial nucleic acid molecules according to the invention, may comprise backbone modifications, i.e., nucleosides/nucleotides that are modified in their phosphate backbone.

The phosphate groups of the backbone can be modified by replacing one or more of the oxygen atoms with a different substituent. Further, the modified nucleosides and nucleotides can include the full replacement of an unmodified phosphate moiety with a modified phosphate as described herein.

Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications:

(Chemically) modified nucleic acids, in particular artificial nucleic acid molecules according to the invention, may comprise (nucleo-)base modifications, i.e., nucleosides/nucleotides that are modified in their nucleobase moiety.

Examples of nucleobases found in RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In some embodiments, the nucleotide analogues/modifications are selected from base modifications, which are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group. In specific embodiments, a modified nucleoside is 5'-O-(1-thiophosphate)-adenosine, 5'-O-(1-thiophosphate)-cytidine, 5'-O-(1-thiophosphate)-guanosine, 5'-O-(1-thiophosphate)-uridine or 5'-O-(1-thiophosphate)-pseudouridine.

In some embodiments, the modified RNA of the invention (or any modified other nucleic acid, in particular RNA, as defined herein) may comprise nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytidine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

In some embodiments, a modified artificial nucleic acid molecule, preferably RNA (or any other nucleic acid, in particular RNA, as defined herein) does not comprise any of the chemical modifications as described herein. Such modified artificial nucleic acids, may nevertheless comprise a lipid modification or a sequence modification as described below.

Lipid Modifications

According to further embodiments, artificial nucleic acid molecules, preferably RNAs, of the invention (or any other nucleic acid, in particular RNA, as defined herein) contains at least one lipid modification.

Such a lipid-modified artificial nucleic acid molecule, preferably RNA of the invention (or said other nucleic acid, in particular RNA, described herein) typically comprises (i) an artificial nucleic acid molecule, preferably RNA as defined herein (or said nucleic acid, in particular RNA), (ii) at least one linker covalently linked with said artificial nucleic acid molecule, preferably RNA (or said other nucleic acid, in particular RNA), and (iii) at least one lipid covalently linked with the respective linker.

Alternatively, the lipid-modified artificial nucleic acid molecule, preferably RNA (or other nucleic acid as defined herein) comprises at least one artificial nucleic acid molecule, preferably RNA (or said other nucleic acid, in particular RNA) and at least one (bifunctional) lipid covalently linked (without a linker) with said artificial nucleic acid molecule, preferably RNA (or said other nucleic acid, in particular RNA).

Alternatively, the lipid-modified artificial nucleic acid molecule, preferably RNA (or any other nucleic acid, in particular RNA, as defined herein) comprises (i) an artificial nucleic acid molecule, preferably RNA (or said other nucleic acid, in particular RNA), (ii) at least one linker covalently linked with said artificial nucleic acid molecule, preferably RNA (or said other nucleic acid, in particular RNA), and (iii) at least one lipid covalently linked with the respective linker, and also (iv) at least one (bifunctional) lipid covalently linked (without a linker) with said artificial nucleic acid molecule, preferably RNA (or said other nucleic acid, in particular RNA).

In this context, it is particularly preferred that the lipid modification is present at the terminal ends of a linear artificial nucleic acid molecule, preferably RNA (or any other nucleic acid defined herein).

Sequence Modifications

According to preferred embodiments, the artificial nucleic acid molecule, preferably RNA, of the invention, preferably an mRNA, or any other nucleic acid as defined herein is "sequence-modified", i.e. comprises at least one sequence modification as described below. Without wishing to be bound by specific theory, such sequence modifications may increase stability and/or enhance expression of the inventive artificial nucleic acid molecules, preferably RNAs.

G/C Content Modification

According to preferred embodiments, the artificial nucleic acid molecule, preferably RNA, more preferably mRNA, of the invention (or any other nucleic acid, in particular RNA, as defined herein) may be modified, and thus stabilized, by modifying its guanosine/cytosine (G/C) content, preferably by modifying the G/C content of the at least one coding sequence. In other words, the artificial nucleic acid molecule, preferably RNA, of the invention (or any other nucleic acid, in particular RNA, as defined herein) and preferably its sequence may be G/C modified.

A "G/C-modified" nucleic acid (preferably RNA) sequence typically refers to a nucleic acid (preferably RNA) comprising a nucleic acid (preferably RNA) sequence that is based on a modified wild-type nucleic acid (preferably RNA) sequence and comprises an altered number of guanosine and/or cytosine nucleotides as compared to said wild-type nucleic acid (preferably RNA) sequence. Such an altered number of G/C nucleotides may be generated by substituting codons containing adenosine or thymidine nucleotides by "synonymous" codons containing guanosine or cytosine nucleotides. Accordingly, the codon substitutions preferably do not alter the encoded amino acid residues, but exclusively alter the G/C content of the nucleic acid (preferably RNA).

In a particularly preferred embodiment of the present invention, the G/C content of the coding sequence of the artificial nucleic acid molecule, preferably RNA, of the invention (or any other nucleic acid, in particular RNA, as defined herein) is modified, particularly increased, compared to the G/C content of the coding sequence of the respective wild-type, i.e. unmodified nucleic acid. The amino acid sequence encoded by the inventive artificial nucleic acid molecule, preferably RNA (or any other nucleic acid, in particular RNA, as defined herein) is preferably not modified as compared to the amino acid sequence encoded by the respective wild-type nucleic acid, preferably RNA.

Such modification of the inventive artificial nucleic acid molecule, preferably RNA (or any other nucleic acid, in particular RNA, as defined herein) is based on the fact that the sequence of any RNA (or other nucleic acid) region to be translated is important for efficient translation of said RNA (or said other nucleic acid). Thus, the composition of the RNA (or said other nucleic acid) and the sequence of various nucleotides are important. In particular, sequences having an increased G (guanosine)/C (cytosine) content are more stable than sequences having an increased A (adenosine)/U (uracil) content.

According to the invention, the codons of the inventive artificial nucleic acid molecule, preferably RNA (or any other nucleic acid, in particular RNA, as defined herein) are therefore varied compared to the respective wild-type nucleic acid, preferably RNA (or said other nucleic acid), while retaining the translated amino acid sequence, such that they include an increased amount of G/C nucleotides.

In respect to the fact that several codons code for one and the same amino acid (so-called degeneration of the genetic code), the most favourable codons for the stability can be determined (so-called alternative codon usage). Depending on the amino acid to be encoded by the inventive artificial nucleic acid molecule, preferably RNA (or any other nucleic acid, in particular RNA, as defined herein), there are various possibilities for modification its nucleic acid sequence, compared to its wild-type sequence. In the case of amino acids, which are encoded by codons, which contain exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U is present. In contrast, codons which contain A and/or U nucleotides can be modified by substitution of other codons, which code for the same amino acids but contain no A and/or U. Examples of these are: the codons for Pro can be modified from CCU or CCA to CCC or CCG; the codons for Arg can be modified from CGU or CGA or AGA or AGG to CGC or CGG; the codons for Ala can be modified from GCU or GCA to GCC or GCG; the codons for Gly can be modified from GGU or GGA to GGC or GGG. In other cases, although A or U nucleotides cannot be eliminated from the codons, it is however possible to decrease the A and U content by using codons which contain a lower content of A and/or U nucleotides. Examples of these are: the codons for Phe can be modified from UUU to UUC; the codons for Leu can be modified from UUA, UUG, CUU or CUA to CUC or CUG;

the codons for Ser can be modified from UCU or UCA or AGU to UCC, UCG or AGC; the codon for Tyr can be modified from UAU to UAC; the codon for Cys can be modified from UGU to UGC; the codon for His can be modified from CAU to CAC; the codon for Gln can be modified from CAA to CAG; the codons for Ile can be modified from AUU or AUA to AUC; the codons for Thr can be modified from ACU or ACA to ACC or ACG; the codon for Asn can be modified from MU to MC; the codon for Lys can be modified from AAA to MG; the codons for Val can be modified from GUU or GUA to GUC or GUG; the codon for Asp can be modified from GAU to GAC; the codon for Glu can be modified from GM to GAG; the stop codon UAA can be modified to UAG or UGA. In the case of the codons for Met (AUG) and Trp (UGG), on the other hand, there is no possibility of sequence modification. The substitutions listed above can be used either individually or in all possible combinations to increase the G/C content of the inventive artificial nucleic acid sequence, preferably RNA sequence (or any other nucleic acid sequence as defined herein) compared to its particular wild-type nucleic acid sequence (i.e. the original sequence). Thus, for example, all codons for Thr occurring in the wild-type sequence can be modified to ACC (or ACG). Preferably, however, for example, combinations of the above substitution possibilities are used:
substitution of all codons coding for Thr in the original sequence (wild-type RNA) to ACC (or ACG) and
substitution of all codons originally coding for Ser to UCC (or UCG or AGC); substitution of all codons coding for Ile in the original sequence to AUC and
substitution of all codons originally coding for Lys to MG and
substitution of all codons originally coding for Tyr to UAC; substitution of all codons coding for Val in the original sequence to GUC (or GUG) and
substitution of all codons originally coding for Glu to GAG and
substitution of all codons originally coding for Ala to GCC (or GCG) and
substitution of all codons originally coding for Arg to CGC (or CGG); substitution of all codons coding for Val in the original sequence to GUC (or GUG) and
substitution of all codons originally coding for Glu to GAG and
substitution of all codons originally coding for Ala to GCC (or GCG) and
substitution of all codons originally coding for Gly to GGC (or GGG) and
substitution of all codons originally coding for Asn to MC; substitution of all codons coding for Val in the original sequence to GUC (or GUG) and
substitution of all codons originally coding for Phe to UUC and
substitution of all codons originally coding for Cys to UGC and
substitution of all codons originally coding for Leu to CUG (or CUC) and
substitution of all codons originally coding for Gln to CAG and
substitution of all codons originally coding for Pro to CCC (or CCG); etc.

Preferably, the G/C content of the coding sequence of the artificial nucleic acid molecule, preferably RNA, of the invention (or any other nucleic acid, in particular RNA, as defined herein) is increased by at least 7%, more preferably by at least 15%, particularly preferably by at least 20%, compared to the G/C content of the coding sequence of the wild-type nucleic acid, preferably RNA (or said other nucleic acid, in particular RNA), which codes for at least one protein as defined herein.

According to preferred embodiments, at least 5%, 10%, 20%, 30%, 40%, 50%, 60%, more preferably at least 70%, even more preferably at least 80% and most preferably at least 90%, 95% or even 100% of the substitutable codons in the region coding for an a CRISPR-associated protein, or a homolog, variant, fragment or derivative as defined herein or the whole sequence of the wild type RNA sequence are substituted, thereby increasing the G/C content of said sequence.

In this context, it is particularly preferable to increase the G/C content of the artificial nucleic acid molecule, preferably RNA, of the invention (or any other nucleic acid, in particular RNA, as defined herein), preferably of its at least one coding sequence, to the maximum (i.e. 100% of the substitutable codons) as compared to the wild-type sequence.

A further preferred modification of the artificial nucleic acid molecule, preferably RNA, of the invention (or any other nucleic acid, in particular RNA, as defined herein) is based on the finding that the translation efficiency is also determined by a different frequency in the occurrence of tRNAs in cells. Thus, if so-called "rare codons" are present in the artificial nucleic acid molecule, preferably RNA, of the invention (or said other nucleic acid, in particular RNA) to an increased extent, the corresponding modified RNA (or said other nucleic acid, in particular RNA) sequence is translated to a significantly poorer degree than in the case where codons coding for relatively "frequent" tRNAs are present.

In some preferred embodiments, in modified artificial nucleic acid molecule, preferably RNAs (or any other nucleic acid) defined herein, the region which codes for a protein is modified compared to the corresponding region of the wild-type nucleic acid, preferably RNA, such that at least one codon of the wild-type sequence, which codes for a tRNA which is relatively rare in the cell, is exchanged for a codon, which codes for a tRNA which is relatively frequent in the cell and carries the same amino acid as the relatively rare tRNA.

Thereby, the sequences of the artificial nucleic acid molecule, preferably RNA, of the invention (or any other nucleic acid, in particular RNA, as defined herein) is modified such that codons for which frequently occurring tRNAs are available are inserted. In other words, according to the invention, by this modification all codons of the wild-type sequence, which code for a tRNA which is relatively rare in the cell, can in each case be exchanged for a codon, which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(6): 660-666. The codons, which use for the particular amino acid the tRNA which occurs the most frequently, e.g. the Gly codon, which uses the tRNA, which occurs the most frequently in the (human) cell, are particularly preferred.

According to the invention, it is particularly preferable to link the sequential G/C content which is increased, in particular maximized, in the modified artificial nucleic acid molecule, preferably RNA, of the invention (or any other nucleic acid, in particular RNA, as defined herein), with the "frequent" codons without modifying the encoded amino acid sequence encoded by the coding sequence of said artificial nucleic acid molecule, preferably RNA. Such preferred embodiments allow the provision of a particularly efficiently translated and stabilized (modified) artificial nucleic acid molecule, preferably RNA (or any other nucleic acid as defined herein).

The determination of a modified artificial nucleic acid molecule, preferably RNA (or any other nucleic acid as defined herein) as described above (increased G/C content; exchange of tRNAs) can be carried out using the computer program explained in WO 02/098443, the disclosure content of which is included in its full scope in the present invention. Using this computer program, the nucleotide sequence of any desired nucleic acid, in particular RNA, can be modified with the aid of the genetic code or the degenerative nature thereof such that a maximum G/C content results, in combination with the use of codons which code for tRNAs occurring as frequently as possible in the cell, the amino acid sequence coded by the modified nucleic acid, in particular RNA, preferably not being modified compared to the non-modified sequence.

Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO 02/098443.

A/U Content Modification

In further preferred embodiments of the present invention, the A/U content in the environment of the ribosome binding site of the artificial nucleic acid molecule, preferably RNA, of the invention (or any other nucleic acid, in particular RNA, as defined herein) is increased compared to the A/U content in the environment of the ribosome binding site of its respective wild-type nucleic acid, preferably RNA (or said other nucleic acid, in particular RNA).

This modification (an increased A/U content around the ribosome binding site) increases the efficiency of ribosome binding to said artificial nucleic acid molecule, preferably RNA (or any other nucleic acid, in particular RNA, as defined herein). An effective binding of the ribosomes to the ribosome binding site (Kozak sequence) in turn has the effect of an efficient translation of the artificial nucleic acid molecule, preferably RNA (or any other nucleic acid, in particular RNA, as defined herein).

DSE Modifications

According to further embodiments of the present invention, the artificial nucleic acid molecule, preferably RNA, of the invention (or any other nucleic acid, in particular RNA, as defined herein) may be modified with respect to potentially destabilizing sequence elements. Particularly, the coding sequence and/or the 5' and/or 3' untranslated region of said artificial nucleic acid molecule, preferably RNA (or said other nucleic acid, in particular RNA) may be modified compared to the respective wild-type nucleic acid, preferably RNA (or said other wild-type nucleic acid) such that it contains no destabilizing sequence elements, the encoded amino acid sequence of the modified artificial nucleic acid molecule, preferably RNA (or said other nucleic acid, in particular RNA) preferably not being modified compared to its respective wild-type nucleic acid, preferably RNA (or said other wild-type nucleic acid).

It is known that, for example in sequences of eukaryotic RNAs, destabilizing sequence elements (DSE) occur, to which signal proteins bind and regulate enzymatic degradation of RNA in vivo. For further stabilization of the modified artificial nucleic acid molecule, preferably RNA, optionally in the region which encodes a CRISPR-associated proteins as defined herein, or any other nucleic acid as defined herein, one or more such modifications compared to the corresponding region of the wild-type nucleic acid, preferably RNA, can therefore be carried out, so that no or substantially no destabilizing sequence elements are contained there.

According to the invention, DSE present in the untranslated regions (3'- and/or 5'-UTR) can also be eliminated from the artificial nucleic acid molecule, preferably RNA (or any other nucleic acid, in particular RNA, as defined herein) by such modifications. Such destabilizing sequences are e.g. AU-rich sequences (AURES), which occur in 3'-UTR sections of numerous unstable RNAs (Caput et al., Proc. Natl. Acad. Sci. USA 1986, 83: 1670 to 1674). The artificial nucleic acid molecule, preferably RNA, of the invention (or any other nucleic acid, in particular RNA, as defined herein) is therefore preferably modified compared to the respective wild-type nucleic acid, preferably RNA (or said respective other wild-type nucleic acid) such that said artificial nucleic acid molecule, preferably RNA (or said other nucleic acid, in particular RNA) contains no such destabilizing sequences. This also applies to those sequence motifs, which are recognized by possible endonucleases, e.g. the sequence GAACAAG, which is contained in the 3'-UTR segment of the gene encoding the transferrin receptor (Binder et al., EMBO J. 1994, 13: 1969 to 1980). These sequence motifs are also preferably removed from said artificial nucleic acid molecule, preferably RNA (or any other nucleic acid, in particular RNA, as defined herein).

Sequences Adapted to Human Codon Usage:

A further preferred modification of the artificial nucleic acid molecule, preferably RNA, of the invention (or any other nucleic acid, in particular RNA, as defined herein) is based on the finding that codons encoding the same amino acid typically occur at different frequencies. According to further preferred embodiments, in the modified artificial nucleic acid molecule, preferably RNA (or said other nucleic acid, in particular RNA), the coding sequence is modified compared to the corresponding region of the respective wild-type nucleic acid, preferably RNA (or said other wild-type nucleic acid) such that the frequency of the codons encoding the same amino acid corresponds to the naturally occurring frequency of that codon according to the human codon usage as e.g. shown in Table 4.

For example, in the case of the amino acid alanine (Ala) present in an amino acid sequence encoded by the at least one coding sequence of the artificial nucleic acid molecule, preferably RNA, of the invention (or any other nucleic acid, in particular RNA, as defined herein), the wild type coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 4).

TABLE 4

Human codon usage table

| Amino acid | codon | fraction | /1000 | Amino acid | codon | fraction | /1000 |
|---|---|---|---|---|---|---|---|
| Ala | GCG | 0.10 | 7.4 | Pro | CCG | 0.11 | 6.9 |
| Ala | GCA | 0.22 | 15.8 | Pro | CCA | 0.27 | 16.9 |
| Ala | GCT | 0.28 | 18.5 | Pro | CCT | 0.29 | 17.5 |
| Ala | GCC* | 0.40 | 27.7 | Pro | CCC* | 0.33 | 19.8 |
| Cys | TGT | 0.42 | 10.6 | Gln | CAG* | 0.73 | 34.2 |
| Cys | TGC* | 0.58 | 12.6 | Gln | CAA | 0.27 | 12.3 |
| Asp | GAT | 0.44 | 21.8 | Arg | AGG | 0.22 | 12.0 |
| Asp | GAC* | 0.56 | 25.1 | Arg | AGA* | 0.21 | 12.1 |
| Glu | GAG* | 0.59 | 39.6 | Arg | CGG | 0.19 | 11.4 |
| Glu | GAA | 0.41 | 29.0 | Arg | CGA | 0.10 | 6.2 |
| Phe | TTT | 0.43 | 17.6 | Arg | CGT | 0.09 | 4.5 |
| Phe | TTC* | 0.57 | 20.3 | Arg | CGC | 0.19 | 10.4 |
| Gly | GGG | 0.23 | 16.5 | Ser | AGT | 0.14 | 12.1 |
| Gly | GGA | 0.26 | 16.5 | Ser | AGC* | 0.25 | 19.5 |
| Gly | GGT | 0.18 | 10.8 | Ser | TCG | 0.06 | 4.4 |
| Gly | GGC* | 0.33 | 22.2 | Ser | TCA | 0.15 | 12.2 |
| His | CAT | 0.41 | 10.9 | Ser | TCT | 0.18 | 15.2 |
| His | CAC* | 0.59 | 15.1 | Ser | TCC | 0.23 | 17.7 |
| Ile | ATA | 0.14 | 7.5 | Thr | ACG | 0.12 | 6.1 |
| Ile | ATT | 0.35 | 16.0 | Thr | ACA | 0.27 | 15.1 |
| Ile | ATC* | 0.52 | 20.8 | Thr | ACT | 0.23 | 13.1 |
| Lys | AAG* | 0.60 | 31.9 | Thr | ACC* | 0.38 | 18.9 |
| Lys | AAA | 0.40 | 24.4 | Val | GTG* | 0.48 | 28.1 |
| Leu | TTG | 0.12 | 12.9 | Val | GTA | 0.10 | 7.1 |
| Leu | TTA | 0.06 | 7.7 | Val | GTT | 0.17 | 11.0 |
| Leu | CTG* | 0.43 | 39.6 | Val | GTC | 0.25 | 14.5 |
| Leu | CTA | 0.07 | 7.2 | Trp | TGG* | 1 | 13.2 |
| Leu | CTT | 0.12 | 13.2 | Tyr | TAT | 0.42 | 12.2 |
| Leu | CTC | 0.20 | 19.6 | Tyr | TAC* | 0.58 | 15.3 |
| Met | ATG* | 1 | 22.0 | Stop | TGA* | 0.61 | 1.6 |
| Asn | AAT | 0.44 | 17.0 | Stop | TAG | 0.17 | 0.8 |
| Asn | AAC* | 0.56 | 19.1 | Stop | TAA | 0.22 | 1.0 |

*most frequent codon

Codon-Optimized Sequences:

As described above, it is preferred according to the invention, that all codons of the wild-type sequence which code for a tRNA, which is relatively rare in the cell, are exchanged for a codon which codes for a tRNA, which is relatively frequent in the cell and which, in each case, carries the same amino acid as the relatively rare tRNA.

Therefore, it is particularly preferred that the most frequent codons are used for each encoded amino acid (see Table 4, most frequent codons are marked with asterisks). Such an optimization procedure increases the codon adaptation index (CAI) and ultimately maximises the CAI. In the context of the invention, sequences with increased or maximized CAI are typically referred to as "codon-optimized" sequences and/or CAI increased and/or maximized sequences. According to preferred embodiments, the artificial nucleic acid molecule, preferably RNA, of the invention (or any other nucleic acid, in particular RNA, as defined herein) comprises at least one coding sequence, wherein the coding sequence is codon-optimized as described herein. More preferably, the codon adaptation index (CAI) of the at least one coding sequence is at least 0.5, at least 0.8, at least 0.9 or at least 0.95. Most preferably, the codon adaptation index (CAI) of the at least one coding sequence is 1.

For example, in the case of the amino acid alanine (Ala) present in the amino acid sequence encoded by the at least one coding sequence of the artificial nucleic acid molecule, preferably RNA, of the invention (or any other nucleic acid, in particular RNA, as defined herein), the wild type coding sequence is adapted in a way that the most frequent human codon "GCC" is always used for said amino acid, or for the amino acid Cysteine (Cys), the wild type sequence is adapted in a way that the most frequent human codon "TGC" is always used for said amino acid etc.

C-Optimized Sequences:

According to preferred embodiments, the artificial nucleic acid molecule, preferably RNA, of the invention (or any other nucleic acid, in particular RNA, as defined herein) is modified by modifying, preferably increasing, the cytosine (C) content of said artificial nucleic acid molecule, preferably RNA (or said other nucleic acid, in particular RNA), in particular in its at least one coding sequence.

In preferred embodiments, the C content of the coding sequence of the artificial nucleic acid molecule, preferably RNA, of the invention (or any other nucleic acid, in particular RNA, as defined herein) is modified, preferably increased, compared to the C content of the coding sequence of the respective wild-type (unmodified) nucleic acid. The amino acid sequence encoded by the at least one coding sequence of the artificial nucleic acid molecule, preferably RNA, of the invention is preferably not modified as compared to the amino acid sequence encoded by the respective wild-type nucleic acid, preferably RNA (or the respective other wild type nucleic acid).

In preferred embodiments, said modified artificial nucleic acid molecule, preferably RNA (or any other nucleic acid, in particular RNA, as defined herein) is modified such that at least 10%, 20%, 30%, 40%, 50%, 60%, 70% or 80%, or at least 90% of the theoretically possible maximum cytosine-content or even a maximum cytosine-content is achieved.

In further preferred embodiments, at least 10%, 20%, 30%, 40%, 50%, 60%, 70%, 80%, 90% or even 100% of the codons of the wild-type nucleic acid, preferably RNA, sequence, which are "cytosine content optimizable" are replaced by codons having a higher cytosine-content than the ones present in the wild type sequence.

In further preferred embodiments, some of the codons of the wild type coding sequence may additionally be modified such that a codon for a relatively rare tRNA in the cell is exchanged by a codon for a relatively frequent tRNA in the cell, provided that the substituted codon for a relatively frequent tRNA carries the same amino acid as the relatively rare tRNA of the original wild type codon. Preferably, all of the codons for a relatively rare tRNA are replaced by a codon for a relatively frequent tRNA in the cell, except codons encoding amino acids, which are exclusively encoded by codons not containing any cytosine, or except for glutamine (Gln), which is encoded by two codons each containing the same number of cytosines.

In further preferred embodiments of the present invention, the modified artificial nucleic acid molecule, preferably RNA (or any other nucleic acid, in particular RNA, as defined herein) is modified such that at least 80%, or at least 90% of the theoretically possible maximum cytosine-content or even a maximum cytosine-content is achieved by means of codons, which code for relatively frequent tRNAs in the cell, wherein the amino acid sequence remains unchanged.

Due to the naturally occurring degeneracy of the genetic code, more than one codon may encode a particular amino acid. Accordingly, 18 out of 20 naturally occurring amino acids are encoded by more than one codon (with Tryp and Met being an exception), e.g. by 2 codons (e.g. Cys, Asp, Glu), by three codons (e.g. Ile), by 4 codons (e.g. Al, Gly, Pro) or by 6 codons (e.g. Leu, Arg, Ser). However, not all codons encoding the same amino acid are utilized with the same frequency under in vivo conditions. Depending on each single organism, a typical codon usage profile is established.

The term 'cytosine content-optimizable codon' as used within the context of the present invention refers to codons, which exhibit a lower content of cytosines than other codons encoding the same amino acid. Accordingly, any wild type codon, which may be replaced by another codon encoding the same amino acid and exhibiting a higher number of cytosines within that codon, is considered to be cytosine-optimizable (C-optimizable). Any such substitution of a C-optimizable wild type codon by the specific C-optimized codon within a wild type coding sequence increases its overall C-content and reflects a C-enriched modified RNA sequence.

According to some preferred embodiments, the artificial nucleic acid molecule, preferably RNA, of the invention (or any other nucleic acid, in particular RNA, as defined herein), and in particular its at least one coding sequence, comprises or consists of a C-maximized sequence containing C-optimized codons for all potentially C-optimizable codons. Accordingly, 100% or all of the theoretically replaceable C-optimizable codons are preferably replaced by C-optimized codons over the entire length of the coding sequence.

In this context, cytosine-content optimizable codons are codons, which contain a lower number of cytosines than other codons coding for the same amino acid.

Any of the codons GCG, GCA, GCU codes for the amino acid Ala, which may be exchanged by the codon GCC encoding the same amino acid, and/or
the codon UGU that codes for Cys may be exchanged by the codon UGC encoding the same amino acid, and/or
the codon GAU which codes for Asp may be exchanged by the codon GAC encoding the same amino acid, and/or
the codon that UUU that codes for Phe may be exchanged for the codon UUC encoding the same amino acid, and/or
any of the codons GGG, GGA, GGU that code Gly may be exchanged by the codon GGC encoding the same amino acid, and/or
the codon CAU that codes for His may be exchanged by the codon CAC encoding the same amino acid, and/or
any of the codons AUA, AUU that code for Ile may be exchanged by the codon AUC, and/or
any of the codons UUG, UUA, CUG, CUA, CUU coding for Leu may be exchanged by the codon CUC encoding the same amino acid, and/or
the codon MU that codes for Asn may be exchanged by the codon MC encoding the same amino acid, and/or
any of the codons CCG, CCA, CCU coding for Pro may be exchanged by the codon CCC encoding the same amino acid, and/or
any of the codons AGG, AGA, CGG, CGA, CGU coding for Arg may be exchanged by the codon CGC encoding the same amino acid, and/or
any of the codons AGU, AGC, UCG, UCA, UCU coding for Ser may be exchanged by the codon UCC encoding the same amino acid, and/or
any of the codons ACG, ACA, ACU coding for Thr may be exchanged by the codon ACC encoding the same amino acid, and/or
any of the codons GUG, GUA, GUU coding for Val may be exchanged by the codon GUC encoding the same amino acid, and/or
the codon UAU coding for Tyr may be exchanged by the codon UAC encoding the same amino acid.

In any of the above instances, the number of cytosines is increased by 1 per exchanged codon. Exchange of all non C-optimized codons (corresponding to C-optimizable codons) of the coding sequence results in a C-maximized coding sequence. In the context of the invention, at least 70%, preferably at least 80%, more preferably at least 90%, of the non C-optimized codons within the at least one coding sequence of the artificial nucleic acid molecule, preferably RNA, of the invention (or any other nucleic acid, in particular RNA, as defined herein) are replaced by C-optimized codons.

It may be preferred that for some amino acids the percentage of C-optimizable codons replaced by C-optimized codons is less than 70%, while for other amino acids the percentage of replaced codons is higher than 70% to meet the overall percentage of C-optimization of at least 70% of all C-optimizable wild type codons of the coding sequence.

Preferably, in a C-optimized artificial nucleic acid molecule, preferably RNA (or any other nucleic acid, in particular RNA, as defined herein), at least 50% of the C-optimizable wild type codons for any given amino acid are replaced by C-optimized codons, e.g. any modified C-enriched RNA (or other nucleic acid, in particular RNA) preferably contains at least 50% C-optimized codons at C-optimizable wild type codon positions encoding any one of the above mentioned amino acids Ala, Cys, Asp, Phe, Gly, His, Ile, Leu, Asn, Pro, Arg, Ser, Thr, Val and Tyr, preferably at least 60%.

In this context codons encoding amino acids, which are not cytosine content-optimizable and which are, however, encoded by at least two codons, may be used without any further selection process. However, the codon of the wild type sequence that codes for a relatively rare tRNA in the cell, e.g. a human cell, may be exchanged for a codon that codes for a relatively frequent tRNA in the cell, wherein both code for the same amino acid. Accordingly, the relatively rare codon GM coding for Glu may be exchanged by the relative frequent codon GAG coding for the same amino acid, and/or the relatively rare codon AAA coding for Lys may be exchanged by the relative frequent codon MG coding for the same amino acid, and/or the relatively rare codon CM coding for Gln may be exchanged for the relative frequent codon CAG encoding the same amino acid.

In this context, the amino acids Met (AUG) and Trp (UGG), which are encoded by only one codon each, remain unchanged. Stop codons are not cytosine-content optimized, however, the relatively rare stop codons amber, ochre (UAA, UAG) may be exchanged by the relatively frequent stop codon opal (UGA).

The single substitutions listed above may be used individually as well as in all possible combinations in order to optimize the cytosine-content of the modified artificial nucleic acid molecule, preferably RNA, compared to the wild type sequence.

Accordingly, the at least one coding sequence as defined herein may be changed compared to the coding sequence of the respective wild type nucleic acid, preferably RNA, in such a way that an amino acid encoded by at least two or more codons, of which one comprises one additional cytosine, such a codon may be exchanged by the C-optimized codon comprising one additional cytosine, wherein the amino acid is preferably unaltered compared to the wild type sequence.

According to particularly preferred embodiments, the inventive combination comprises an artificial nucleic acid molecule, preferably RNA, comprising (in addition to the 5' UTR and 3' UTR specified herein) at least one coding sequence as defined herein, wherein (a) the G/C content of the at least one coding sequence of said artificial nucleic acid molecule, preferably RNA, is increased compared to the G/C content of the corresponding coding sequence of the corresponding wild-type nucleic acid (preferably RNA), and/or (b) wherein the C content of the at least one coding sequence of said artificial nucleic acid molecule, preferably RNA, is increased compared to the C content of the corresponding coding sequence of the corresponding wild-type nucleic acid (preferably RNA), and/or (c) wherein the codons in the at least one coding sequence of said artificial nucleic acid molecule, preferably RNA, are adapted to human codon usage, wherein the codon adaptation index (CAI) is preferably increased or maximized in the at least one coding sequence of said artificial nucleic acid molecule, preferably RNA, and wherein the amino acid sequence encoded by said artificial nucleic acid molecule, preferably RNA, is preferably not being modified compared to the amino acid sequence encoded by the corresponding wild-type nucleic acid (preferably RNA).

Modified Nucleic Acid Sequences

The sequence modifications indicated above can in general be applied to any of the nucleic acid sequences described herein, and are particularly envisaged to be applied to the coding sequences comprising or consisting of nucleic acid sequences encoding CRISPR-associated proteins as defined herein, and optionally NLS or other peptide or protein moieties, domains or tags. The modifications (including chemical modifications, lipid modifications and sequence modifications) may, if suitable or necessary, be combined with each other in any combination, provided that the combined modifications do not interfere with each other, and preferably provided that the encoded CRISPR-associated protein (and the NLS, signal sequence, protein/peptide tag) preferably retains its desired biological functionality or property, as defined above.

In preferred embodiments, artificial nucleic acids according to the invention comprise a coding sequence encoding a CRISPR-associated protein, wherein said coding sequence has been modified as described above.

In some preferred embodiments, artificial nucleic acids according to the invention comprise a coding sequence encoding a Cas9 protein or a homolog, variant, fragment or derivative thereof, wherein said coding sequence comprises or consists of a nucleic acid sequence according to SEQ ID NO: 412; 3474-3887 2314-2327; 4634-4647; 5794-5807; 6954-6967; 8114-8127; 413-425; 3490-3503; 3506-3519; 3522-3535; 3538-3551; 3554-3567; 3570-3583; 3586-3599; 3602-3615; 3618-3631; 3634-3647; 3650-3663; 3666-3679; 3682-3695; 9514-9527; 9626-9639; 9738-9751; 9850-9863; 9962-9975, 10074-10087; 10186-10199; 10298-10311; 2330-2343; 2346-2359; 2362-2375; 2378-2391; 2394-2407; 2410-2423; 2426-2439; 2442-2455; 2458-2471; 2474-2487; 2490-2503; 2506-2519; 2522-2535; 9498-9511; 9610-9623; 9722-9735; 9834-9847; 9946-9959; 10058-10071; 10170-10183-10282-10295; 4650-4663; 4666-4679; 4682-4695; 4698-4711; 4714-4727; 4730-4743; 4746-4759; 4762-4775; 4778-4791; 4794-4807; 4810-4823; 4826-4839; 4842-4855; 9530-9543; 9642-9655; 9754-9767; 9866-9879; 9978-9991; 10090-10103; 10202-10215; 10314-10327; 5810-5823; 5826-5839; 5842-5855; 5858-5871; 5874-5887; 5890-5903; 5906-5919; 5922-5935; 5938-5951; 5954-5967; 5970-5983, 5986-5999; 6002-6015; 9546-9559; 9658-9671; 9770-9783; 9882-9895; 9994-10007; 10106-10119; 10218-10231; 10330-10343; 6970-6983; 6986-6999; 7002-7015; 7018-7031; 7034-7047; 7050-7063; 7066-7079; 7082-7095; 7098-7111; 7114-7127; 7130-7143; 7146-7159; 7162-7175; 9562-9575; 9674-9687; 9786-9799; 9898-9911; 10010-10023; 10122-10135; 10234-10247; 10346-10359; 8130-8143; 8146-8159; 8162-8175; 8178-8191; 8194-8207; 8210-8223; 8226-8239; 8242-8255; 8258-8271; 8274-8287; 8290-8302; 8306-8319; 8322-8335; 9578-9591; 9690-9703; 9802-9815; 9914-9927; 10026-10039; 10138-10151; 10250-10263; 10362-10375; 9290-9303; 9306-9319; 9322-9335; 9338-9351; 9354-9367; 9370-9383; 9386-9399; 9402-9415; 9418-9431; 9434-9447; 9450-9463; 9466-9479; 9482-9495; 9594-9607; 9706-9719; 9818-9831; 9930-9943; 10042-10055; 10154-10167; 10266-10279; 10378-10391, or a homolog, variant or fragment thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

In some preferred embodiments, artificial nucleic acids according to the invention comprise a coding sequence encoding a Cpf1 protein or a homolog, variant, fragment or derivative thereof, wherein said coding sequence comprises or consists of a nucleic acid sequence according to SEQ ID NO: 10552; 3458-3459; 3460-3473; 2298-2299; 4618-4619; 5778-5779; 6938-6939; 8098-8099; 9258-9259; 2300-2313; 4620-4633; 5780-5793; 6940-6953; 8100-8113; 9260-9273; 3488-3489; 10396; 2328-2329; 10395; 4648-4649; 10397; 5808-5809; 10398; 6968-6969; 10399; 8128-8129; 10400; 9274-9287; 3504-3505; 3520-3521; 3536-3537; 3552-3553; 3568-3669; 3584-3585; 3600-3601; 3616-3617; 3632-3633; 3648-3649; 3664-3665; 3680-3681; 3696-3697; 9528-9529;

9640-9641; 9752-9753; 9864-9865; 9976-9977; 10088-10089; 10200-10201; 10312-10313; 10403; 10410; 10417; 10424; 10431; 10438; 10445; 10452; 10459; 10466; 10473; 10480; 10487; 10494; 10501; 10508; 10515; 10522; 10529; 10536; 10543 2344-2345; 2360-2361; 2376-2377; 2392-2393; 2408-2409; 2424-2425; 2440-2441; 2456-2457; 2472-2473; 2489-2490; 2504-2505; 2520-2521; 2536-2537; 9512-9513; 9624-9625; 9736-9737; 9848-9849; 9960-9961; 10072-10073; 10184-10185; 10296-10297; 10402; 10409; 10416; 10423; 10430; 10437; 10444; 10451; 10458; 10465; 10472; 10479; 10486; 10493; 10500; 10507; 10514; 10521; 10528; 10535; 10542; 4664-4665; 4680-4681; 4696-4697; 4712-4713; 4728-4729; 4744-4745; 4760-4761; 4776-4777; 4792-4793; 4808-4809; 4824-4825; 4840-4841; 4856-4857; 9544-9545; 9656-9657; 9768-9769; 9880-9881; 9992-9993; 10104-10105; 10216-10217; 10328-10329; 10404; 10411; 10418; 10425; 10432; 10439; 10446; 10453; 10460; 10467; 10474; 10481; 10488; 10495; 10502; 10509; 10516; 10523; 10530; 10537; 10544; 5824-5825; 5840-5841; 5856-5857; 5872-5873; 5888-5889; 5904-5905; 5920-5921; 5936-5937; 5952-5953; 5968-5969; 5984-5985; 6000-6001; 6016-6017; 9560-9561; 9672-9673; 9784-9785; 9896-9897; 10008-10009; 10120-10121; 10232-10233; 10344-10345; 10405; 10412; 10419; 10426; 10433; 10440; 10447; 10454; 10461; 10468; 10475; 10482; 10489; 10496; 10503; 10510; 10517; 10524; 10531; 10538; 10545; 7033; 7048-7049; 7064-7065; 7080-7081; 7096-7097; 7112-7113; 7128-7129; 7144-7145; 7160-7161; 7176-7177; 9576-9577; 9688-9689; 9800-9801; 9912-9913; 10024-10025; 10136-10137; 10248-10249; 10360-10361; 10406; 10413; 10420; 10427; 10434; 10441; 10448; 10455; 10462; 10469; 10476; 10483; 10490; 10497; 10504; 10511; 10518; 10525; 10532; 10539; 10546; 8144-8145; 8160-8160; 8176-8177; 8192-8193; 8208-8209; 8224-8225; 8240-8241; 8256-8257; 8272-8273; 8288-8289; 8304-8305; 8320-8321; 8336-8337; 9592-9593; 9704-9705; 9816-9817; 9928-9929; 10040-10041; 10152-10153; 10264-10265; 10376-10377; 10407; 10414; 10421; 10428; 10435; 10442; 10449; 10456; 10463; 10470; 10477; 10484; 10491; 10498; 10505; 10512; 10519; 10526; 10533; 10540; 10547; 9288-9289; 10401; 10553; 10582-10583 10579-10580; 10585-10586; 10588-10589; 10591-10592; 10594-10595; 10597-10598; 10554-10574; 10601; 10602; 10615; 10616; 10629; 10630; 10643; 10644; 10657; 10658; 10671; 10672; 10685; 10686; 10699; 10700; 10713; 10714; 10727; 10728; 10741; 10742; 10755; 10756; 10769; 10770; 10783; 10784; 10797; 10798; 10811; 10812; 10825; 10826; 10839; 10840; 10853; 10854; 10867; 10868; 10881; 10882; 10603; 10604; 10617; 10618; 10631; 10632; 10645; 10646; 10659; 10660; 10673; 10674; 10687; 10688; 10701; 10702; 10715; 10716; 10729; 10730; 10743; 10744; 10757; 10758; 10771; 10772; 10785; 10786; 10799; 10800; 10813; 10814; 10827; 10828; 10841; 10842; 10855; 10856; 10869; 10870; 10883; 10884; 10605; 10606; 10619; 10620; 10633; 10634; 10647; 10648; 10661; 10662; 10675; 10676; 10689; 10690; 10703; 10704; 10717; 10718; 10731; 10732; 10745; 10746; 10759; 10760; 10773; 10774; 10787; 10788; 10801; 10802; 10815; 10816; 10829; 10830; 10843; 10844; 10857; 10858; 10871; 10872; 10885; 10886; 10607; 10608; 10621; 10622; 10635; 10636; 10649; 10650; 10663; 10664; 10677; 10678; 10691; 10692; 10705; 10706; 10719; 10720; 10733; 10734; 10747; 10748; 10761; 10762; 10775; 10776; 10789; 10790; 10803; 10804; 10817; 10818; 10831; 10832; 10845; 10846; 10859; 10860; 10873; 10874; 10887; 10888; 10609; 10610; 10623; 10624; 10637; 10638; 10651; 10652; 10665; 10666; 10679; 10680; 10693; 10694; 10707; 10708; 10721; 10722; 10735; 10736; 10749; 10750; 10763; 10764; 10777; 10778; 10791; 10792; 10805; 10806; 10819; 10820; 10833; 10834; 10847; 10848; 10861; 10862; 10875; 10876; 10889; 10890; 10611; 10612; 10625; 10626; 10639; 10640; 10653; 10654; 10667; 10668; 10681; 10682; 10695; 10696; 10709; 10710; 10723; 10724; 10737; 10738; 10751; 10752; 10765; 10766; 10779; 10780; 10793; 10794; 10807; 10808; 10821; 10822; 10835; 10836; 10849; 10850; 10863; 10864; 10877; 10878; 10891; 10892; 9304-9305; 9320-9321; 9336-9337; 9352-9353; 9368-9369; 9384-9385; 9400-9401; 9416-9417; 9432-9433; 9448-9449; 9464-9465; 9480-9481; 9496-9497; 9608-9609; 9720-9721; 9832-9833; 9944-9945; 10056-10057; 10168-10169; 10280-10281; 10392-10393; 10408; 10415; 10422; 10429; 10436; 10443; 10450; 10457; 10464; 10471; 10478; 10485; 10492; 10499; 10506; 10513; 10520; 10527; 10534; 10541; 10548 or a homolog, variant or fragment thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity any of these sequences.

The artificial nucleic acid according to the invention may, in the same (monocistronic nucleic acid) or different (multicistronic nucleic acid) coding region(s), encode further proteins or peptide. The respective encoding nucleic acid sequences can be subjected to the same sequence modifications as described above. In particular, the coding sequence of the inventive artificial nucleic acid may comprise one or more sequence(s) encoding one or more nuclear localization signals (NLS), that are preferably fused to the nucleic acid sequence encoding the CRISPR-associated protein. Those sequences can be modified as described above, as well.

The modified (or "optimized") coding sequences can be combined with any of the UTRs disclosed herein.

Therefore, in some preferred embodiments, artificial nucleic acids according to the invention comprise at least one 5' UTR element as defined herein, at least one 3' UTR element as defined herein and a coding sequence encoding a Cas9 or Cpf1 protein or a (functional) homolog, variant, fragment or derivative thereof, wherein said artificial nucleic acid molecule comprises or consists of a nucleic acid sequence according to SEQ ID NO:413; 2330-2345; 3490-3505; 4650-4665; 5810-5825; 6970-6985; 8130-8145; 9290-9305; 10402-10408; 10554; 10599-10612 (HSD17B4/Gnas.1); SEQ ID NO:414; 2346-2361; 3506-3521; 4666-4681; 5826-5841; 6986-7001; 8146-8161; 9306-9321; 10409-10415; 10555; 10613-10626 (Slc7a3.1/Gnas.1); SEQ ID NO:415; 2362-2377; 3522-3537; 4682-4697; 5842-5857; 7002-7017; 8162-8177; 9322-9337; 10416-10422; 10556; 10627-10640 (ATP5A1/CASP.1); SEQ ID NO:416; 2378-2393; 3538-3553; 4698-4713; 5858-5873; 7018-7033; 8178-8193; 9338-9353; 10423-10429; 10557; 10641-10654 (Ndufa4.1/PSMB3.1); SEQ ID NO:417; 2394-2409; 3554-3569; 4714-4729; 5874-5889; 7034-7049; 8194-8209; 9354-9369; 10430-10436; 10558; 10655-10668 (HSD17B4/PSMB3.1); SEQ ID NO:418; 2410-2425; 3570-3585; 4730-4745; 5890-5905; 7050-7065; 8210-8225; 9370-9385; 10437-10443; 10559; 10669-10682 (RPL32var/albumin7); SEQ ID NO:419; 2426-2441; 3586-3601; 4746-4761; 5906-5921; 7066-7081; 8226-8241; 9386-9401; 10444-10450; 10560; 10683-10696 (32L4/albumin7); SEQ ID NO:420; 2442-2457; 3602-3617; 4762-4777; 5922-5937; 7082-7097; 8242-8257; 9402-9417; 10451-10457; 10561; 10697-10710 (HSD17B4/CASP1.1); SEQ ID NO:421; 2458-2473; 3618-3633; 4778-4793; 5938-5953; 7098-7113; 8258-8273; 9418-9433; 10458-10464; 10562; 10711-10724 (Slc7a3.1/

CASP1.1); SEQ ID NO:422; 2474-2489; 3634-3649; 4794-4809; 5954-5969; 7114-7129; 8274-8289; 9434-9449; 10465-10471; 10563; 10725-10738 (Slc7a3.1/PSMB3.1); SEQ ID NO:423; 2490-2505; 3650-3665; 4810-4825; 5970-5985; 7130-7145; 8290-8305; 9459-9450; 10472-10478; 10564; 10739-10752 (Nosip.1/PSMB3.1); SEQ ID NO:424; 2506-2521; 3666-3681; 4826-4841; 5986-6001; 7146-7161; 8306-8321; 9466-9481; 10479-10485; 10565; 10753-10766 (Ndufa4.1/RPS9.1); SEQ ID NO:425; 2522-2537; 3682-3697; 4842-4857; 6002-6017; 7162-7177; 8322-8337; 9482-9497; 10486-10492; 10566; 10767-10780 (HSD17B4/RPS9.1); SEQ ID NO:9498-9609; 10493-10499; 10567; 10781-10794 (ATP5A1/Gnas.1); SEQ ID NO:9610-9721; 10500-10506; 10568; 10795-10808 (Ndufa4.1/COX6B1.1); SEQ ID NO:9722-9833; 10507-10513; 10569; 10809-10822 (Ndufa4.1/Gnas.1); SEQ ID NO:9834-9945; 10514-10520; 10570; 10823-10836 (Ndufa4.1/Ndufa1.1); SEQ ID NO:9946-10057; 10521-10527; 10571; 10837-10850 (Nosip.1/Ndufa1.1); SEQ ID NO:10058-10169; 10528-10534; 10572; 10851-10864 (Rpl31.1/Gnas.1); SEQ ID NO:10170-10281; 10535-10541; 10573; 10865-10878 (TUBB4B.1/RPS9.1); SEQ ID NO:10282-10393; 10542-10548; 10574; 10879-10892 (Ubqln2.1/RPS9.1) or a homolog, variant or fragment of any one of said sequences, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences. It is easily apparent for a skilled worker which SEQ ID NO belongs to which protein (Cas9 or Cpf1) by the guidance given in the "Other Information" line in the sequence listing under <223>, where it is disclosed whether the respective SEQ ID NO: resembles a Cpf1 variant mRNA product or a Cas9 variant mRNA product.

5' Cap

According to further preferred embodiments of the invention, a modified artificial nucleic acid molecule, preferably RNA (or any other nucleic acid, in particular RNA) as defined herein, can be modified by the addition of a so-called '5' cap' structure, which preferably stabilizes said artificial nucleic acid molecule, preferably RNA (or said other nucleic acid, in particular RNA) as described herein.

A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an mRNA. m7GpppN is the 5'-cap structure, which naturally occurs in mRNA transcribed by polymerase II and is therefore preferably not considered as modification comprised in a modified mRNA in this context. Accordingly, a "modified" artificial nucleic acid molecule, preferably RNA (or any other nucleic acid, in particular RNA, as defined herein) may comprise a m7GpppN as 5'-cap, but additionally said modified artificial nucleic acid molecule, preferably RNA (or other nucleic acid) typically comprises at least one further modification as defined herein.

Further examples of 5'cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-cap structures are regarded as at least one modification in this context.

Particularly preferred modified 5'-cap structures are cap1 (methylation of the ribose of the adjacent nucleotide of m7G), cap2 (additional methylation of the ribose of the 2nd nucleotide downstream of the m7G), cap3 (additional methylation of the ribose of the 3rd nucleotide downstream of the m7G), cap4 (methylation of the ribose of the 4th nucleotide downstream of the m7G), ARCA (anti-reverse cap analogue, modified ARCA (e.g. phosphothioate modified ARCA), CleanCap (TriLink) and or a Cap-structure as disclosed in WO2017053297A1 (herewith incorporated by reference), inosine, N1-methyl-guanosine, 2'-fluoro-guanosine, 7-deaza-guanosine, 8-oxo-guanosine, 2-amino-guanosine, LNA-guanosine, and 2-azido-guanosine.

According to preferred embodiments, the artificial nucleic acid comprises a methyl group at the 2'-O position of the ribose-2'-O position of the first nucleotide adjacent to the cap structure at the 5' end of the RNA (cap-1). Typically, methylation may be accomplished by the action of Cap 2'-O-Methyltransferase, utilizing m7GpppN capped artificial nucleic acids (preferably RNA) as a substrate and S-adenosylmethionine (SAM) as a methyl donor to methylate capped RNA (cap-0) resulting in the cap-1 structure. The cap-1 structure has been reported to enhance mRNA translation efficiency and hence may help improving expression efficacy of the inventive artificial nucleic acid, preferably RNA, described herein.

Poly(A)

According to further preferred embodiments, the artificial nucleic acid molecule, preferably RNA, of the invention (or any other nucleic acid, in particular RNA, as defined herein) contains a poly(A) sequence.

A poly(A) sequence, also called poly(A) tail or 3'-poly(A) tail, is typically understood to be a sequence of adenosine nucleotides, e.g., of up to about 400 adenosine nucleotides, e.g. from about 20 to about 400, preferably from about 50 to about 400, more preferably from about 50 to about 300, even more preferably from about 50 to about 250, most preferably from about 60 to about 250 adenosine nucleotides. As used herein, a poly(A) sequence may also comprise about 10 to 200 adenosine nucleotides, preferably about 10 to 100 adenosine nucleotides, more preferably about 40 to 80 adenosine nucleotides or even more preferably about 50 to 70 adenosine nucleotides. A poly(A) sequence is typically located at the 3'end of an RNA, in particular a mRNA.

Accordingly, in further preferred embodiments, the artificial nucleic acid molecule, preferably RNA, of the invention (or any other nucleic acid, in particular RNA, as defined herein) contains at its 3' terminus a poly(A) tail of typically about 10 to 200 adenosine nucleotides, preferably about 10 to 100 adenosine nucleotides, more preferably about 40 to 80 adenosine nucleotides or even more preferably about 50 to 70 adenosine nucleotides.

Preferably, the poly(A) sequence in the artificial nucleic acid molecule, preferably RNA, of the invention (or said other nucleic acid, in particular RNA) is derived from a DNA template by RNA in vitro transcription. Alternatively, the poly(A) sequence may also be obtained in vitro by common methods of chemical-synthesis without being necessarily transcribed from a DNA-progenitor.

Moreover, poly(A) sequences, or poly(A) tails may be generated by enzymatic polyadenylation of the artificial nucleic acid molecule, preferably RNA, of the invention (or said other nucleic acid, in particular RNA) using commercially available polyadenylation kits and corresponding protocols known in the art. Polyadenylation is typically understood to be the addition of a poly(A) sequence to a nucleic acid molecule, such as an RNA molecule, e.g. to a premature mRNA. Polyadenylation may be induced by a so-called polyadenylation signal. This signal is preferably located within a stretch of nucleotides at the 3'-end of the mRNA to be polyadenylated. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called premature-mRNA). Typically, RNA maturation (from pre-mRNA to mature mRNA) comprises a step of polyadenylation.

Accordingly, the artificial nucleic acid molecule, preferably RNA, of the invention (or any other nucleic acid, in particular RNA, as defined herein) may comprise a polyadenylation signal which conveys polyadenylation to a (transcribed) RNA by specific protein factors (e.g. cleavage and polyadenylation specificity factor (CPSF), cleavage stimulation factor (CstF), cleavage factors I and II (CF I and CF II), poly(A) polymerase (PAP)).

In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

Poly(C)

According to further preferred embodiments, the artificial nucleic acid molecule, preferably RNA, of the invention (or any other nucleic acid, in particular RNA, as defined herein) contains a poly(C) tail on the 3' terminus of typically about 10 to 200 cytosine nucleotides, preferably about 10 to 100 cytosine nucleotides, more preferably about 20 to 70 cytosine nucleotides or even more preferably about 20 to 60 or even 10 to 40 cytosine nucleotides.

Histone Stem-Loop (HSL)

In some preferred embodiments, the artificial nucleic acid molecule, preferably RNA, of the invention (or any other nucleic acid, in particular RNA, as defined herein) comprises a histone stem-loop (HSL) sequence/structure. Such histone stem-loop sequences are preferably selected from histone stem-loop sequences as disclosed in WO 2012/019780, the disclosure of which is incorporated herewith by reference.

A histone stem-loop sequence, suitable to be used within the present invention, is preferably selected from at least one of the following formulae (I) or (II):

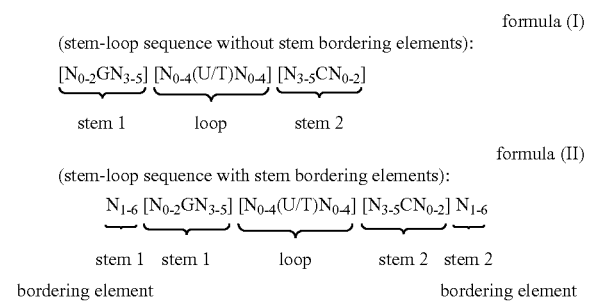

| stem1 or stem2 bordering elements $N_{1-6}$ | is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof; |
|---|---|
| stem1 $[N_{0-2}GN_{3-5}]$ | is reverse complementary or partially reverse complementary with element stem2, and is a consecutive sequence between of 5 to 7 nucleotides; wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof; wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof, and wherein G is guanosine or an analogue thereof, and may be optionally replaced by a cytidine or an analogue thereof, provided that its complementary nucleotide cytidine in stem2 is replaced by guanosine; |
| loop sequence $[N_{0-4}(U/T)N_{0-4}]$ | is located between elements stem1 and stem2, and is a consecutive sequence of 3 to 5 nucleotides, more preferably of 4 nucleotides; wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally thymidine; |
| stem2 $[N_{3-5}CN_{0-2}]$ | is reverse complementary or partially reverse complementary with element stem1, and is a consecutive sequence between of 5 to 7 nucleotides; | wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;

wherein $N_{0-2}$ is a consecutive sequence of 0 to 2, preferably of 0 to 1, more preferably of 1 N, wherein each N is independently from another selected from a nucleotide selected from A, U, T, G or C or a nucleotide analogue thereof; and wherein C is cytidine or an analogue thereof, and may be optionally replaced by a guanosine or an analogue thereof provided that its complementary nucleoside guanosine in stem1 is replaced by cytidine;

wherein stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one ore more bases in one stem do not have a complementary base in the reverse complementary sequence of the other stem.

According to a further preferred embodiment, the artificial nucleic acid molecule, preferably RNA, of the invention (or any other nucleic acid, in particular RNA, as defined herein) may comprise at least one histone stem-loop (HSL) sequence according to at least one of the following specific formulae (Ia) or (IIa):

formula (Ia)
(stem-loop sequence without stem bordering elements):

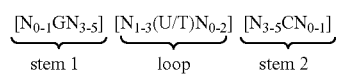

formula (IIa)
(stem-loop sequence with stem bordering elements):

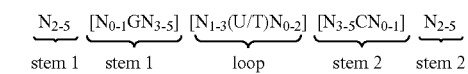

wherein:
N, C, G, T and U are as defined above.

According to a further more particularly preferred embodiment, the artificial nucleic acid molecule, preferably RNA, of the invention (or any other nucleic acid, in particular RNA, as defined herein) may comprise at least one histone stem-loop sequence according to at least one of the following specific formulae (Ib) or (IIb):

formula (Ib)
(stem-loop sequence without stem bordering elements):

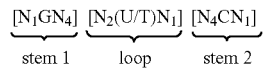

formula (IIb)
(stem-loop sequence with stem bordering elements):

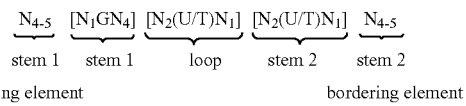

wherein:
N, C, G, T and U are as defined above.

A particularly preferred histone stem-loop sequence is the sequence CAAAGGCTCTTTTCAGAGCCACCA or more preferably the corresponding RNA sequence CAAAGGCUCUUUUCAGAGCCACCA.

miRNA Moieties

In a further embodiment, non-coding moieties, i.e. f.e. miRNA moieties are combined with the sequences of the invention. Non-coding moieties can be selected from nucleic acid sequences from one or more disclosed the following list:

a 5'-UTR;
a 3'-UTR;
a miRNA moiety;
a Cap;
a poly(C) sequence
a histone stem-loop sequence
a poly(A) sequence or a polyadenylation signal;
an IRES moiety
a hairpin moiety
moieties for RNA binding proteins
a moiety that prevents 3'-5' degradation
moieties that regulate RNA decay rates The above are generic terms. Specific moieties falling under these generic terms are also provided by the present invention. Details of moieties from the above list, including sequences pertaining to specific embodiments, are provided below.

While the above list provides items in the singular form, it is equally possible that more than one respective moiety is selected. Nucleic acid moieties not included in the above list may equally be selected. Preferably, at least one module or moiety is from the above list.

In typical embodiments, at least one 5'-UTR moiety and/or at least one 3'-UTR moiety is selected. Preferably, at least one 5'-UTR and at least one 3'-UTR is selected.

A miRNA may also be selected as a moiety in the present invention. Any miRNA moiety known in the art may be selected. Such a moiety can be selected from microRNA target sequences, microRNA sequences, or microRNA seeds. For example, miRNA sequences (microRNA target sequences, microRNA sequences, or microRNA seeds) are described in WO2015085318A2, US2005/0261218, US20170211066, WO2017201332, WO2017201328, WO2017201349, WO2017201347, WO2017201348, WO2017201342, WO2017201346, US20160177295, WO2014113089, EP2946014, WO2016100812, WO2013126803 and US2005/0059005 (all aforementioned references are incorporated herein by reference). Identification of microRNA, microRNA target regions, and their expression patterns and role in biology have been reported (Bonauer et al., Curr Drug Targets 2010 11:943-949; Anand and Cheresh, Curr Opin Hematol 2011, 18: 171-176; Contreras and Rao Leukemia, 2012 26:404-413; Barrel, Cell, 2009 136:215-233; Landgraf et al., Cell, 2007 129: 1401-1414 (all aforementioned references are incorporated herein by reference).

In general, microRNAs (or miRNA) are 19-25 nucleotide long noncoding RNAs. miRNAs bind to 3'-UTR of nucleic acid molecules. This causes down-regulation of gene expression, either by reducing nucleic acid molecule stability or by inhibiting translation. As a module of the present invention, the polynucleotides of the present invention may comprise one or more microRNA target sequences, microRNA sequences, or microRNA seeds.

As used herein, the term "microRNA site" refers to a polynucleotide sequence to which a microRNA can bind or otherwise associate. "binding" typically occurs by Watson-Crick hybridization; but any otherwise stable association of the microRNA with the target sequence at or adjacent to the microRNA site is also comprised in the concept of a "microRNA site" according to the present invention.

In general, a microRNA sequence comprises a "seed" region, i.e., a sequence typically in the region of positions 2-8 of a mature microRNA. The seed region sequence has perfect Watson-Crick complementarity to the miRNA target sequence. Such a microRNA seed may comprise positions 2-8, or alternatively 2-7 of the mature microRNA. Thus, in one embodiment, a microRNA seed comprises 7 nucleotides (e.g., nucleotides 2-8 of the mature microRNA), wherein the seed-complementary site in the corresponding miRNA target is flanked by an adenine (A) opposed to microRNA position 1. In another embodiment, a microRNA seed comprises 6 nucleotides (e.g., nucleotides 2-7 of the mature microRNA), wherein the seed-complementary site in the corresponding miRNA target is flanked by an adenine (A) opposed to microRNA position 1. Respective nucleic acid modules are disclosed in Grimson et al.; Mol Cell. 2007 Jul. 6; 27(1):91-105.

In the present invention, a microRNA target sequence is typically designed to be comprised in a 3'-UTR or otherwise 3' (upstream) of an open reading frame. In such case, the miRNA target sequence is thought to target the molecule for degradation or reduced translation, provided that a corresponding microRNA in question is available. This allows to control any undesired off-target effects upon delivery of the nucleic acid molecule of the present invention.

In case it is not desired to translate an mRNA in the liver, but the mRNA is transported to the liver or otherwise ends up there, then miR-122, a microRNA abundant in liver, can inhibit the expression of the nucleic acid of the present invention, if one or multiple target sites of miR-122 are present (e.g. designed) in the 3'-UTR region of the polynucleotide of the present invention. Introduction of one or multiple binding sites for different microRNA can be engineered to further influence (e.g. decrease) the longevity, stability, and protein translation of polynucleotides.

In contrast, in case it is indeed desired to translate an mRNA, microRNA binding sites can be engineered out of (i.e. removed from) sequences in which they occur, e.g., in order to increase protein expression in specific tissues. For example, one or more miR-122 binding sites may be removed to improve protein expression in the liver.

Thereby, regulation of expression in specific tissues can be accomplished through introduction or removal or one or several microRNA binding sites. For examples microRNAs are known to regulate mRNA, and thereby protein expression, without limitation in liver (miR-122), heart (miR-Id, miR-149), endothelial cells (miR-17-92, miR-126), adipose tissue (let-7, miR-30c), kidney (miR-192, miR-194, miR-204), myeloid cells (miR-142-3p, miR-142-5p, miR-16, miR-21, miR-223, miR-24, miR-27), muscle (miR-133, miR-206, miR-208), and lung epithelial cells (let-7, miR-133, miR-126). MicroRNA can also regulate complex biological processes such as angiogenesis (miR-132) (e.g. Anand and Cheresh, Curr. Opin. Hematol. 2011, 18: 171-176).

Thus, in general, according to the modular design principle of the present invention, binding sites for microRNAs may be removed or introduced, in order to tailor the expression of the polynucleotides expression to desired cell types or tissues, or to the context of relevant biological processes. Listings of miRNA sequences and binding sites are available to the public. Any sequence disclosed in the literature discussed herein may be used in the context of the present invention: examples of microRNA that drive tissue- or disease-specific gene expression are listed in Getner and Naldini, Tissue Antigens. 2012, 80:393-403. An example of incorporation of microRNA seed sites is incorporation of miR-142 sites into a UGT1A1-expressing lentiviral vector, which causes reduced expression in antigen-presenting cells, leading to the absence of an immune response against the virally expressed UGT1A1 as disclosed in Schmitt et al., Gastroenterology 2010; 139:999-1007; Gonzalez-Asequinolaza et al. Gastroenterology 2010, 139:726-729. Thus, incorporation of one or more miR-142 seed sites into mRNA is thought to be important in the case of treatment of patients with complete protein deficiencies (UGT1A1 type I, LDLR-deficient patients, CRIM-negative Pompe patients, etc.). Thereby, the nucleic acid molecule of the present invention can be designed to fit such purposes.

Any polynucleotide may be selected which is characterized by at least 80% identity, at least 85% identity, preferably at least 90% identity, and more preferably at least 95% identity to any of such miRNA sequences.

Owing to the different expression patterns of microRNA in different cell types, the present invention allows to specifically design polynucleotide molecules for targeted expression in specific cell types, or under specific biological conditions. Through introduction of tissue-specific microRNA binding sites, polynucleotides can be designed that for protein expression in a tissue or in the context of a biological condition.

In one embodiment of the invention, the artificial nucleic acid molecule of the invention encoding a CRISPR-associated protein (e.g. Cas9, Cpf1) of the invention comprises at least one miRNA sequence selected from the group consisting of hsa-miR-27a-3p, hsa-miR-99b-5p, hsa-miR-21-5p, hsa-miR-142-5p, hsa-miR-27a-3p, hsa-miR-21-5p, hsa-miR-223-3p, hsa-miR-150-5p, and hsa-miR-142-5p.

Constructs

The artificial nucleic acid molecule, preferably RNA, of the invention, which comprises at least one coding sequence as defined herein comprises at least one 5' UTR and at least one 3' UTR as described herein, and optionally at least one histone stem-loop.

The 3' UTR of the artificial nucleic acid molecule, preferably RNA, of the invention (or any other nucleic acid, in particular RNA, as defined herein) may further comprise a poly(A) and/or a poly(C) sequence as defined herein.

The single elements of the 3' UTR may occur therein in any order from 5' to 3' along the sequence of the artificial nucleic acid molecule, preferably RNA, of the invention.

In addition, further elements as described herein, may also be contained, such as a stabilizing sequence as defined herein (e.g. derived from the UTR of a globin gene), IRES sequences, etc. Each of the elements may also be repeated in the artificial nucleic acid molecule, preferably RNA, of the invention at least once (particularly in di- or multicistronic constructs), e.g. twice or more. As an example, the single elements may be present in the artificial nucleic acid molecule, preferably RNA, of the invention in the following order:

5'-coding sequence-histone stem-loop-poly(A)/(C) sequence-3'; or
5'-coding sequence-poly(A)/(C) sequence-histone stem-loop-3'; or
5'-coding sequence-histone stem-loop-polyadenylation signal-3'; or
5'-coding sequence-polyadenylation signal-histone stem-loop-3'; or
5'-coding sequence-histone stem-loop-histone stem-loop-poly(A)/(C) sequence-3'; or
5'-coding sequence-histone stem-loop-histone stem-loop-polyadenylation signal-3'; or
5'-coding sequence-stabilizing sequence-poly(A)/(C) sequence-histone stem-loop-3'; or
5'-coding sequence-stabilizing sequence-poly(A)/(C) sequence-poly(A)/(C) sequence-histone stem-loop-3'; etc.

According to further embodiments, the artificial nucleic acid molecule, preferably RNA, preferably further comprises at least one of the following structural elements: a histone-stem-loop structure, preferably a histone-stem-loop in its 3' untranslated region; a 5'-cap structure; a poly-A tail; or a poly(C) sequence.

According to some embodiments, it is particularly preferred that if, in addition to a CRISPR-associated protein, a further peptide or protein is encoded by the at least one coding sequence as defined herein—the encoded peptide or protein is preferably no histone protein, no reporter protein (e.g. Luciferase, GFP and its variants (such as eGFP, RFP or BFP), and/or no marker or selection protein, including alpha-globin, galactokinase and Xanthine:Guanine phosphoribosyl transferase (GPT), hypoxanthine-guanine phosphoribosyltransferase (HGPRT), beta-galactosidase, galactokinase, alkaline phosphatase, secreted embryonic alkaline phosphatase (SEAP) or a resistance gene (such as a resistance gene against neomycin, puromycin, hygromycin and zeocin). In preferred embodiments, the artificial nucleic acid molecule, preferably RNA, does not encode a reporter gene or a marker gene. In preferred embodiments, the artificial nucleic acid molecule, preferably RNA, does not encode luciferase. In other embodiments, the artificial nucleic acid molecule, preferably RNA, does not encode GFP or a variant thereof.

Specifically, artificial nucleic acid molecules, in particular RNAs, according to the invention may comprise preferably in 5' to 3' direction, the following elements:
a) a 5'-CAP structure, preferably m7GpppN or Cap1
b) a 5'-UTR element, which comprises or consists of a nucleic acid sequence, which is derived from a 5'-UTR as defined herein, preferably comprising a nucleic acid sequence corresponding to the nucleic acid sequence according to SEQ ID NO: 1; 3; 5; 7; 9; 11; 13; 15; 17; 19; or 21 or a homolog, fragment or variant thereof;
c) at least one coding sequence as defined herein;
d) a 3'-UTR element, which comprises or consists of a nucleic acid sequence, which is derived from a 3'-UTR as defined herein, preferably comprising a nucleic acid sequence corresponding to the nucleic acid sequence according to SEQ ID NO: 23; 25; 27; 29; 31; 33 or 35, or a homolog, a fragment or a variant thereof,
e) optionally a poly(A) tail, preferably consisting of 10 to 1000, 10 to 500, 10 to 300 10 to 200, 10 to 100, 40 to 80 or 50 to 70 adenosine nucleotides,
f) optionally a poly(C) tail, preferably consisting of 10 to 200, 10 to 100, 20 to 70, 20 to 60 or 10 to 40 cytosine nucleotides, and
g) optionally a histone stem-loop.

Preferred artificial nucleic acid constructs are discussed in detail below.

HSD17B4-Derived 5' UTR Element and GNAS-Derived 3' UTR Element:

In some preferred embodiments, artificial nucleic acids according to the invention comprise or consist of at least one 5' UTR element derived from a 5'UTR of a HSD17B4 gene, or from a homolog, a fragment or a variant thereof and at least one 3' UTR element derived from a 3'UTR of a GNAS gene, or from a homolog, a fragment or a variant thereof; wherein said artificial nucleic acid comprises or consists of a nucleic acid sequence according to SEQ ID NO: 413; 2330-2345; 3490-3505; 4650-4665; 5810-5825; 6970-6985; 8130-8145; 9290-9305; 10402-10408; 10554; 10599-10612, or a homolog, variant or fragment thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

SLC7A3-Derived 5' UTR Element and GNAS-Derived 3'UTR Element:

In some preferred embodiments, artificial nucleic acids according to the invention comprise or consist of at least one 5' UTR element derived from a 5'UTR of a SLC7A3gene, or from a homolog, a fragment or a variant thereof and at least one 3' UTR element derived from a 3'UTR of a GNAS gene, or from a homolog, a fragment or a variant thereof, wherein said artificial nucleic acid comprises or consists of a nucleic acid sequence according to SEQ ID NO: 414; 2346-2361; 3506-3521; 4666-4681; 5826-5841; 6986-7001; 8146-8161; 9306-9321; 10409-10415; 10555; 10613-10626, or a homolog, variant or fragment thereof, in particular a nucleic acid sequence in having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity sequence identity to any of these sequences.

ATP5A1-Derived 5' UTR Element and CASP1-Derived 3' UTR Element:

In some preferred embodiments, artificial nucleic acids according to the invention comprise or consist of at least one 5' UTR element derived from a 5'UTR of a ATP5A1 gene, or from a homolog, a fragment or a variant thereof and at least one 3' UTR element derived from a 3'UTR of a CASP1 gene, or from a homolog, a fragment or a variant thereof, wherein said artificial nucleic acid comprises or consists of a nucleic acid sequence according to SEQ ID NO: 415; 2362-2377; 3522-3537; 4682-4697; 5842-5857; 7002-7017; 8162-8177; 9322-9337; 10416-10422; 10556; 10627-10640, or a homolog, variant or fragment thereof, in particular a nucleic acid sequence in having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

NDUFA4-Derived 5' UTR Element and PSMB3-Derived 3' UTR Element:

In some preferred embodiments, artificial nucleic acids according to the invention comprise or consist of at least one 5' UTR element derived from a 5'UTR of a NDUFA4 gene, or from a homolog, a fragment or a variant thereof and at least one 3' UTR element derived from a 3'UTR of a PSMB3 gene, or from a homolog, a fragment or a variant thereof, wherein said artificial nucleic acid comprises or consists of a nucleic acid sequence according to SEQ ID NO: 416; 2378-2393; 3538-3553; 4698-4713; 5858-5873; 7018-7033; 8178-8193; 9338-9353; 10423-10429; 10557; 10641-10654, or a homolog, variant or fragment thereof, in particular a nucleic acid sequence in having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

HSD17B4-Derived 5' UTR Element and PSMB3-Derived 3' UTR Element:

In some preferred embodiments, artificial nucleic acids according to the invention comprise or consist of at least one 5' UTR element derived from a 5'UTR of a HSD17B4 gene, or from a homolog, a fragment or a variant thereof and at least one 3' UTR element derived from a 3'UTR of a PSMB3 gene, or from a homolog, a fragment or a variant thereof, wherein said artificial nucleic acid comprises or consists of a nucleic acid sequence according to SEQ ID NO: 417; 2394-2409; 3554-3569; 4714-4729; 5874-5889; 7034-7049; 8194-8209; 9354-9369; 10430-10436; 10558; 10655-10668, or a homolog, variant or fragment thereof, in particular a nucleic acid sequence in having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

RPL32-Derived 5' UTR Element and ALB-Derived 3' UTR Element:

In some preferred embodiments, artificial nucleic acids according to the invention comprise or consist of at least one 5' UTR element derived from a 5'UTR of a RPL32 gene, or from a homolog, a fragment or a variant thereof and at least one 3' UTR element derived from a 3'UTR of a ALB gene, or from a homolog, a fragment or a variant thereof, wherein said artificial nucleic acid comprises or consists of a nucleic acid sequence according to SEQ ID NO: 418; 2410-2425; 3570-3585; 4730-4745; 5890-5905; 7050-7065; 8210-8225; 9370-9385; 10437-10443; 10559; 10669-10682 or a homolog, variant or fragment thereof, in particular a nucleic acid sequence in having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

HSD17B4-Derived 5' UTR Element and CASP1-Derived 3' UTR Element:

In some preferred embodiments, artificial nucleic acids according to the invention comprise or consist of at least one 5' UTR element derived from a 5'UTR of a HSD17B4 gene, or from a homolog, a fragment or a variant thereof and at least one 3' UTR element derived from a 3'UTR of a CASP1 gene, or from a homolog, a fragment or a variant thereof, wherein said artificial nucleic acid comprises or consists of a nucleic acid sequence according to SEQ ID NO: 420; 2442-2457; 3602-3617; 4762-4777; 5922-5937; 7082-7097; 8242-8257; 9402-9417; 10451-10457; 10561; 10697-10710, or a homolog, variant or fragment thereof, in particular a nucleic acid sequence in having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

SLC7A3-Derived 5' UTR Element and CASP1-Derived 3' UTR Element:

In some preferred embodiments, artificial nucleic acids according to the invention comprise or consist of at least one 5' UTR element derived from a 5'UTR of a SLC7A3gene, or from a homolog, a fragment or a variant thereof and at least one 3' UTR element derived from a 3'UTR of a CASP1 gene, or from a homolog, a fragment or a variant thereof, wherein said artificial nucleic acid comprises or consists of a nucleic acid sequence according to SEQ ID NO: 421; 2458-2473; 3618-3633; 4778-4793; 5938-5953; 7098-7113; 8258-8273; 9418-9433; 10458-10464; 10562; 10711-10724, or a homolog, variant or fragment thereof, in particular a nucleic acid sequence in having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

SLC7A3-Derived 5' UTR Element and PSMB3-Derived 3' UTR Element:

In some preferred embodiments, artificial nucleic acids according to the invention comprise or consist of at least one 5' UTR element derived from a 5'UTR of a SLC7A3 gene, or from a homolog, a fragment or a variant thereof and at least one 3' UTR element derived from a 3'UTR of a PSMB3 gene, or from a homolog, a fragment or a variant thereof, wherein said artificial nucleic acid comprises or consists of a nucleic acid sequence according to SEQ ID NO: 422; 2474-2489; 3634-3649; 4794-4809; 5954-5969; 7114-7129; 8274-8289; 9434-9449; 10465-10471; 10563; 10725-10738, or a variant or fragment of any of said sequences, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

NOSIP-Derived 5' UTR Element and PSMB3-Derived 3' UTR Element:

In some preferred embodiments, artificial nucleic acids according to the invention comprise or consist of at least one 5' UTR element derived from a 5'UTR of a NOSIP gene, or from a homolog, a fragment or a variant thereof and at least one 3' UTR element derived from a 3'UTR of a PSMB3 gene, or from a homolog, a fragment or a variant thereof, wherein said artificial nucleic acid comprises or consists of a nucleic acid sequence according to SEQ ID NO: 423; 2490-2505; 3650-3665; 4810-4825; 5970-5985; 7130-7145; 8290-8305; 9459-9450; 10472-10478; 10564; 10739-10752, or a homolog, variant or fragment thereof, in particular a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

NDUFA4-Derived 5' UTR Element and RPS9-Derived 3' UTR Element:

In some preferred embodiments, artificial nucleic acids according to the invention comprise or consist of at least one 5' UTR element derived from a 5'UTR of a NDUFA4 gene, or from a homolog, a fragment or a variant thereof and at least one 3' UTR element derived from a 3'UTR of a RPS9 gene, or from a homolog, a fragment or a variant thereof, wherein said artificial nucleic acid comprises or consists of a nucleic acid sequence according to SEQ ID NO: 424; 2506-2521; 3666-3681; 4826-4841; 5986-6001; 7146-7161; 8306-8321; 9466-9481; 10479-10485; 10565; 10753-10766, or a homolog, variant or fragment thereof, in particular a nucleic acid sequence in having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

HSD17B4-Derived 5' UTR Element and RPS9-Derived 3' UTR Element:

In some preferred embodiments, artificial nucleic acids according to the invention comprise or consist of at least one 5' UTR element derived from a 5'UTR of a HSD17B4 gene, or from a homolog, a fragment or a variant thereof and at least one 3' UTR element derived from a 3'UTR of a RPS9 gene, or from a homolog, a fragment or a variant thereof, wherein said artificial nucleic acid comprises or consists of a nucleic acid sequence according to SEQ ID NO: 425; 2522-2537; 3682-3697; 4842-4857; 6002-6017; 7162-7177; 8322-8337; 9482-9497; 10486-10492; 10566; 10767-10780, or a homolog, variant or fragment thereof, in particular a nucleic acid sequence in having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

In other preferred embodiments, artificial nucleic acids according to the invention comprise or consist of at least one 5' UTR and 3' UTR element as described herein below (or from a homolog, a fragment or a variant thereof), wherein the artificial nucleic acid comprises or consists of a nucleic acid sequence according to the SEQ ID NO: in brackets behind the specific UTR-combination:

ATP5A1/Gnas.1 (SEQ ID NO: 9498-9609; 10493-10499; 10567; 10781-10794);
Ndufa4.1/COX6B1.1 (SEQ ID NO: 9610-9721; 10500-10506; 10568; 10795-10808);
Ndufa4.1/Gnas.1 (SEQ ID NO: 9722-9833; 10507-10513; 10569; 10809-10822);
Ndufa4.1/Ndufa1.1 (SEQ ID NO: 9834-9945; 10514-10520; 10570; 10823-10836);
Nosip.1/Ndufa1.1 (SEQ ID NO: 9946-10057; 10521-10527; 10571; 10837-10850);
Rpl31.1/Gnas.1 (SEQ ID NO: 10058-10169; 10528-10534; 10572; 10851-10864);
TUBB4B.1/RPS9.1 (SEQ ID NO: 10170-10281; 10535-10541; 10573; 10865-10878);
Ubqln2.1/RPS9.1 (SEQ ID NO: 10282-10393; 10542-10548; 10574; 10879-10892).

In other preferred embodiments, the 3' end of the constructs of the invention is selected from the group consisting of A64-C30-HSL-N5; A64-HSL-N5; A64-N5; A64-N5; A64-C5-N5; A64-C5-N5; A64-C10-N5; A64-C10-N5; A64-C15-N5; A40-HSL-A50-N5; HSL-N5; A64-HSL-NR; A64-N5; and A64-C15-N5.

Complexation

In preferred embodiments, the at least one artificial nucleic acid molecule, preferably RNA, of the invention (or any other nucleic acid as described herein) is provided in a complexed form, i.e. complexed or associated with one or more (poly-)cationic compounds, preferably with (poly-)cationic polymers, (poly-)cationic peptides or proteins, e.g. protamine, (poly-)cationic polysaccharides and/or (poly-)cationic lipids. In this context, the terms "complexed" or "associated" refer to the essentially stable combination of the at least one artificial nucleic acid molecule, preferably RNA (or said other nucleic acid) with one or more of the aforementioned compounds into larger complexes or assemblies without covalent binding.

Lipids

According to preferred embodiments, the artificial nucleic acid molecule, preferably RNA, of the invention, is complexed or associated with lipids (in particular cationic and/or neutral lipids) to form one or more liposomes, lipoplexes, lipid nanoparticles, or nanoliposomes.

Therefore, in some embodiments, the artificial nucleic acid molecule, preferably RNA, of the invention (or any other nucleic acid, in particular RNA, as defined herein) is provided in the form of a lipid-based formulation, in particular in the form of liposomes, lipoplexes, and/or lipid nanoparticles comprising said artificial nucleic acid molecule, preferably RNA (or said other nucleic acid, in particular RNA).

Lipid Nanoparticles

According to some preferred embodiments, the artificial nucleic acid molecule, preferably RNA, of the invention (or any other nucleic acid, in particular RNA, as defined herein), is complexed or associated with lipids (in particular cationic and/or neutral lipids) to form one or more lipid nanoparticles. In some embodiments, the nanoparticle(s) of the invention comprise(s) at least one artificial nucleic acid molecule encoding a CRISPR-associated protein as described herein, and additionally at least one gRNA as described herein.

Preferably, lipid nanoparticles (LNPs) comprise: (a) at least one artificial nucleic acid molecule, preferably RNA, of the invention (or any other nucleic acid as defined herein), (b) a cationic lipid, (c) an aggregation reducing agent (such as polyethylene glycol (PEG) lipid or PEG-modified lipid), (d) optionally a non-cationic lipid (such as a neutral lipid), and (e) optionally, a sterol.

In some embodiments, LNPs comprise, in addition to the at least one artificial nucleic acid molecule, preferably RNA, of the invention (or any other nucleic acid as defined herein), (i) at least one cationic lipid; (ii) a neutral lipid; (iii) a sterol, e.g., cholesterol; and (iv) a PEG-lipid, in a molar ratio of about 20-60% cationic lipid:5-25% neutral lipid:25-55% sterol; 0.5-15% PEG-lipid.

In some embodiments, the artificial nucleic acid molecule, preferably RNA, of the invention, (or any other nucleic acid as defined herein), may be formulated in an aminoalcohol lipidoids. Aminoalcohol lipidoids which may be used in the present invention may be prepared by the methods described in U.S. Pat. No. 8,450,298, herein incorporated by reference in its entirety.

(i) Cationic Lipids

LNPs may include any cationic lipid suitable for forming a lipid nanoparticle. Preferably, the cationic lipid carries a net positive charge at about physiological pH.

The cationic lipid may be an amino lipid. As used herein, the term "amino lipid" is meant to include those lipids having one or two fatty acid or fatty alkyl chains and an amino head group (including an alkylamino or dialkylamino group) that may be protonated to form a cationic lipid at physiological pH.

The cationic lipid may be, for example, N,N-dioleyl-N,N-dimethylammonium chloride (DODAC), N,N-distearyl-N,N-dimethylammonium bromide (DDAB), 1,2-dioleoyltrimethyl ammonium propane chloride (DOTAP) (also known as N-(2,3-dioleoyloxy)propyl)-N,N,N-trimethylammonium chloride and 1,2-Dioleyloxy-3-trimethylaminopropane chloride salt), N-(1-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-di-γ-linolenyloxy-N,N-dimethylaminopropane (γ-DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyoxo-3-(2-N,N-dimethylamino)ethoxypropane (DLin-EG-DM A), 2,2-Dilinoleyl-4-dimethylaminomethyl-[1,3]-dioxolane (DLin-K-DMA) or analogs thereof, (3aR,5s,6aS)—N,N-dimethyl-2,2-di((9Z,12Z)-octadeca-9,12-dienyl)tetrahydro-3aH-cyclopenta[d][1,3]dioxol-5-amine, (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxy-dodecyl)amino)ethyl)piperazin-1-yl)ethylazanediyl)didodecan-2-ol (C12-200), 2,2-dilinoleyl-4-(2-dimethylaminoethyl)-[1,3]-dioxolane (DLin-K-C2-DMA), 2,2-dilinoleyl-4-dimethylaminomethyl-[1,3]-dioxolane (DLin-K-DMA), (6Z,9Z,28Z,31Z)-heptatriaconta-6,9,28,31-tetraen-19-yl 4-(dimethylamino) butanoate (DLin-M-C3-DMA), 3-((6Z,9Z,28Z,31Z)-heptatriaconta-6,9,28,3l-tetraen-19-yloxy)-N,N-dimethylpropan-1-amine (MC3 Ether), 4-((6Z,9Z,28Z,31 Z)-heptatriaconta-6,9,28,31-tetraen-19-yloxy)-N,N-dimethylbutan-l-amine (MC4 Ether), or any combination of any of the foregoing.

Other cationic lipids include, but are not limited to, N,N-distearyl-N,N-dimethylammonium bromide (DDAB), 3P—(N—(N',N'-dimethylaminoethane)-carbamoyl)cholesterol (DC-Choi), N-(1-(2,3-dioleyloxy)propyl)-N-2-(sperminecarboxamido)ethyl)-N,N-dimethylammonium trifluoracetate (DOSPA), dioctadecylamidoglycyl carboxyspermine (DOGS), 1,2-dileoyl-sn-3-phosphoethanolamine (DOPE), 1,2-dioleoyl-3-dimethylammonium propane (DODAP), N-(l,2-dimyristyloxyprop-3-yl)-N,N-dimethyl-N-hydroxyethyl ammonium bromide (DMRIE), and 2,2-Dilinoleyl-4-dimethylaminoethyl-[1,3]-dioxolane (XTC). Additionally, commercial preparations of cationic lipids can be used, such as, e.g., LIPOFECTIN (including DOTMA and DOPE, available from GIBCO/BRL), and LIPOFECTAMINE (comprising DOSPA and DOPE, available from GIBCO/BRL).

Other suitable cationic lipids are disclosed in International Publication Nos. WO 09/086558, WO 09/127060, WO 10/048536, WO 10/054406, WO 10/088537, WO 10/129709, and WO 2011/153493; U.S. Patent Publication Nos. 2011/0256175, 2012/0128760, and 2012/0027803; U.S. Pat. No. 8,158,601; and Love et al, PNAS, 107(5), 1864-69, 2010.

Other suitable amino lipids include those having alternative fatty acid groups and other dialkylamino groups, including those in which the alkyl substituents are different (e.g., N-ethyl-N-methylamino-, and N-propyl-N-ethylamino-). In general, amino lipids having less saturated acyl chains are more easily sized, particularly when the complexes must be sized below about 0.3 microns, for purposes of filter sterilization. Amino lipids containing unsaturated fatty acids with carbon chain lengths in the range of C14 to C22 may be used. Other scaffolds can also be used to separate the amino group and the fatty acid or fatty alkyl portion of the amino lipid.

In some embodiments, amino or cationic lipids have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of the lipid be present in the charged or neutral form. Lipids that have more than one protonatable or deprotonatable group, or which are zwitterionic, are not excluded from use in the invention.

In some embodiments, the protonatable lipids have a pKa of the protonatable group in the range of about 4 to about 11, e.g., a pKa of about 5 to about 7.

LNPs can include two or more cationic lipids. The cationic lipids can be selected to contribute different advantageous properties. For example, cationic lipids that differ in properties such as amine pKa, chemical stability, half-life in circulation, half-life in tissue, net accumulation in tissue, or toxicity can be used in the LNP.

In particular, the cationic lipids can be chosen so that the properties of the mixed-LNP are more desirable than the properties of a single-LNP of individual lipids.

In some embodiments, the cationic lipid is present in a ratio of from about 20 mol % to about 70 or 75 mol % or from about 45 to about 65 mol % or about 20, 25, 30, 35, 40, 45, 50, 55, 60, 65, or about 70 mol % of the total lipid present in the LNP. In further embodiments, the LNPs comprise from about 25% to about 75% on a molar basis of cationic lipid, e.g., from about 20 to about 70%, from about 35 to about 65%, from about 45 to about 65%, about 60%, about 50% or about 40% on a molar basis (based upon 100% total moles of lipid in the lipid nanoparticle). In some embodiments, the ratio of cationic lipid to nucleic acid is from about 3 to about 15, such as from about 5 to about 13 or from about 7 to about 11.

In some embodiments, the liposome may have a molar ratio of nitrogen atoms in the cationic lipid to the phosphates in the RNA (N:P ratio) of between 1:1 and 20:1 as described in International Publication No. WO2013/006825A1, herein incorporated by reference in its entirety. In other embodiments, the liposome may have a N:P ratio of greater than 20:1 or less than 1:1.

In some aspects, the lipid is selected from the group consisting of 98N12-5, C12-200, and cKK-E12. In one embodiment, the nucleic acids may be formulated in an aminoalcohol lipidoid. Aminoalcohol lipidoids which may be used in the present invention may be prepared by the methods described in U.S. Pat. No. 8,450,298, herein incorporated by reference in its entirety.

In another embodiment, ionizable lipids can also be the compounds as disclosed in International Publication No. WO2015/074085A1, U.S. Appl. Nos. 61/905,724 and Ser. No. 15/614,499, WO2015074085A1, or U.S. Pat. Nos. 9,593,077, 61/905,724, 9,593,077, 9,567,296, 15/614,499 and 9,567,296, hereby incorporated by reference in their entirety.

Ionizable lipids can also be the compounds as disclosed in Tables 1, 2 and 3 and claims 1-24 of International Publication No. WO2017/075531A1, hereby incorporated by reference in its entirety. In another embodiment, ionizable lipids can also be the compounds as disclosed in International Publication No. WO2015/074085A1 (i.e. ATX-001 to ATX-032 or the compounds as mentioned in claims 1-26), U.S. Appl. Nos. 61/905,724 and Ser. No. 15/614,499 or U.S. Pat. Nos. 9,593,077 and 9,567,296 hereby incorporated by reference in their entirety.

(ii) Neutral and Non-Cationic Lipids

The non-cationic lipid can be a neutral lipid, an anionic lipid, or an amphipathic lipid. Neutral lipids, when present, can be any of a number of lipid species which exist either in an uncharged or neutral zwitterionic form at physiological pH. Such lipids include, for example, diacylphosphatidylcholine, diacylphosphatidylethanolamine, ceramide, sphingomyelin, dihydrosphingomyelin, cephalin, and cerebrosides. The selection of neutral lipids for use in the particles described herein is generally guided by consideration of, e.g., LNP size and stability of the LNP in the bloodstream. Preferably, the neutral lipid is a lipid having two acyl groups (e.g., diacylphosphatidylcholine and diacylphosphatidylethanolamine).

In some embodiments, the neutral lipids contain saturated fatty acids with carbon chain lengths in the range of $C_{10}$ to $C_{20}$. In other embodiments, neutral lipids with mono or diunsaturated fatty acids with carbon chain lengths in the range of $C_{10}$ to $C_{20}$ are used. Additionally, neutral lipids having mixtures of saturated and unsaturated fatty acid chains can be used.

Suitable neutral lipids include, but are not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), dimyristoyl phosphatidylcholine (DMPC), distearoyl-phosphatidyl-ethanolamine (DSPE), SM, 16-O-monomethyl PE, 16-O-dimethyl PE, 18-1-trans PE, 1-stearoyl-2-oleoyl-phosphatidyethanolamine (SOPE), cholesterol, or a mixture thereof. Anionic lipids suitable for use in LNPs include, but are not limited to, phosphatidylglycerol, cardiolipin, diacylphosphatidylserine, diacylphosphatidic acid, N-dodecanoyl phosphatidylethanoloamine, N-succinyl phosphatidylethanolamine, N-glutaryl phosphatidylethanolamine, lysylphosphatidylglycerol, and other anionic modifying groups joined to neutral lipids.

Amphipathic lipids refer to any suitable material, wherein the hydrophobic portion of the lipid material orients into a hydrophobic phase, while the hydrophilic portion orients toward the aqueous phase. Such compounds include, but are not limited to, phospholipids, aminolipids, and sphingolipids. Representative phospholipids include sphingomyelin, phosphatidylcholine, phosphatidylethanolamine, phosphatidylserine, phosphatidylinositol, phosphatidic acid, palmitoyloleoyl phosphatdylcholine, lysophosphatidylcholine, lysophosphatidylethanolamine, dipalmitoylphosphatidylcholine, dioleoylphosphatidylcholine, distearoylphosphatidylcholine, or dilinoleoylphosphatidylcholine. Other phosphorus-lacking compounds, such as sphingolipids, glycosphingolipid families, diacylglycerols, and beta-acyloxyacids, can also be used.

In some embodiments, the non-cationic lipid is present in a ratio of from about 5 mol % to about 90 mol %, about 5 mol % to about 10 mol %, about 5, 10, 15, 20, 25, 30, 35, 40, 45, 50, 55, 60, 65, 70, 75, 80, 85, or about 90 mol % of the total lipid present in the LNP.

In some embodiments, LNPs comprise from about 0% to about 15 or 45% on a molar basis of neutral lipid, e.g., from about 3 to about 12% or from about 5 to about 10%. For instance, LNPs may include about 15%, about 10%, about 7.5%, or about 7.1% of neutral lipid on a molar basis (based upon 100% total moles of lipid in the LNP).

(iii) Sterols

The sterol is preferably cholesterol.

The sterol can be present in a ratio of about 10 mol % to about 60 mol % or about 25 mol % to about 40 mol % of the LNP. In some embodiments, the sterol is present in a ratio of about 10, 15, 20, 25, 30, 35, 40, 45, 50, 55, or about 60 mol % of the total lipid present in the LNP. In other embodiments, LNPs comprise from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the LNP).

(iv) Aggregation Reducing Agents

The aggregation reducing agent can be a lipid capable of reducing aggregation.

Examples of such lipids include, but are not limited to, polyethylene glycol (PEG)-modified lipids, monosialoganglioside Gm1, and polyamide oligomers (PAO) such as those described in U.S. Pat. No. 6,320,017, which is incorporated by reference in its entirety. Other compounds with uncharged, hydrophilic, steric-barrier moieties, which prevent aggregation during formulation, like PEG, Gm1 or ATTA, can also be coupled to lipids. ATTA-lipids are described, e.g., in U.S. Pat. No. 6,320,017, and PEG-lipid conjugates are described, e.g., in U.S. Pat. Nos. 5,820,873, 5,534,499 and 5,885,613, each of which is incorporated by reference in its entirety.

The aggregation reducing agent may be, for example, selected from a polyethyleneglycol (PEG)-lipid including, without limitation, a PEG-diacylglycerol (DAG), a PEG-dialkylglycerol, a PEG-dialkyloxypropyl (DAA), a PEG-phospholipid, a PEG-ceramide (Cer), or a mixture thereof (such as PEG-Cer14 or PEG-Cer20). The PEG-DAA conjugate may be, for example, a PEG-dilauryloxypropyl (C12), a PEG-dimyristyloxypropyl (C14), a PEG-dipalmityloxypropyl (C16), or a PEG-distearyloxypropyl (C18). Other pegylated-lipids include, but are not limited to, polyethylene glycol-didimyristoyl glycerol (C14-PEG or PEG-C14, where PEG has an average molecular weight of 2000 Da) (PEG-DMG); (R)-2,3-bis(octadecyloxy)propyl-1-(methoxy poly(ethylene glycol)2000)propylcarbamate) (PEG-DSG); PEG-carbamoyl-1,2-dimyristyloxypropylamine, in which PEG has an average molecular weight of 2000 Da (PEG-cDMA); N-Acetylgalactosamine-((R)-2,3-bis(octadecyloxy)propyl-1-(methoxy poly(ethylene glycol)2000)propyl-carbamate)) (GalNAc-PEG-DSG); mPEG (mw2000)-diastearoylphosphatidyl-ethanolamine (PEG-DSPE); and polyethylene glycol-dipalmitoylglycerol (PEG-DPG).

In some embodiments, the aggregation reducing agent is PEG-DMG. In other embodiments, the aggregation reducing agent is PEG-c-DMA.

In another embodiment, PEG-lipids can also be the compounds as disclosed in US20150376115A1 or WO2015199952, hereby incorporated by reference in their entirety.

LNP Composition

The composition of LNPs may be influenced by, inter alia, the selection of the cationic lipid component, the degree of cationic lipid saturation, the nature of the PEGylation, the ratio of all components and biophysical parameters such as its size. In one example by Semple et al. (Semple et al. Nature Biotech. 2010 28: 172-176; herein incorporated by reference in its entirety), the LNP composition was composed of 57.1% cationic lipid, 7.1% dipalmitoylphosphatidylcholine, 34.3% cholesterol, and 1.4% PEG-c-DMA (Basha et al. Mol Ther. 2011 19:2186-2200; herein incorporated by reference in its entirety).

In some embodiments, LNPs may comprise from about 35 to about 45% cationic lipid, from about 40% to about 50% cationic lipid, from about 50% to about 60% cationic lipid and/or from about 55% to about 65% cationic lipid. In some embodiments, the ratio of lipid to nucleic acid may range from about 5:1 to about 20:1, from about 10:1 to about 25:1, from about 15:1 to about 30:1 and/or at least 30:1.

The average molecular weight of the PEG moiety in the PEG-modified lipids can range from about 500 to about 8,000 Daltons (e.g., from about 1,000 to about 4,000 Daltons). In one preferred embodiment, the average molecular weight of the PEG moiety is about 2,000 Daltons.

The concentration of the aggregation reducing agent may range from about 0.1 to about 15 mol %, per 100% total moles of lipid in the LNP. In some embodiments, LNPs include less than about 3, 2, or 1 mole percent of PEG or PEG-modified lipid, based on the total moles of lipid in the LNP. In further embodiments, LNPs comprise from about 0.1% to about 20% of the PEG-modified lipid on a molar basis, e.g., about 0.5 to about 10%, about 0.5 to about 5%, about 10%, about 5%, about 3.5%, about 1.5%, about 0.5%, or about 0.3% on a molar basis (based on 100% total moles of lipids in the LNP).

Different LNPs having varying molar ratios of cationic lipid, non-cationic (or neutral) lipid, sterol (e.g., cholesterol), and aggregation reducing agent (such as a PEG-modified lipid) on a molar basis (based upon the total moles of lipid in the lipid nanoparticles) as depicted in Table 5 below. In preferred embodiments, the lipid nanoparticle formulation of the invention consists essentially of a lipid mixture in molar ratios of about 20-70% cationic lipid:5-45% neutral lipid:20-55% cholesterol, 0.5-15% PEG-modified lipid, more preferably in molar ratios of about 20-60% cationic lipid:5-25% neutral lipid:25-55% cholesterol:0.5-15% PEG-modified lipid.

TABLE 5

Lipid-based formulations

Molar ratio of Lipids
(based upon 100% total moles of lipid in the lipid nanoparticle)

| # | Cationic Lipid | Non-Cationic (or Neutral) Lipid | Sterol | Aggregation Reducing Agent (e.g., PEG-lipid) |
|---|---|---|---|---|
| 1 | from about 35% to about 65% | from about 3% to about 12% or 15% | from about 15% to about 45% | from about 0.1% to about 10% (preferably from about 0.5% to about 2% or 3%) |
| 2 | from about 20% to about 70% | from about 5% to about 45% | from about 20% to about 55% | from about 0.1% to about 10% (preferably from about 0.5% to about 2% or 3%) |
| 3 | from about 45% to about 65% | from about 5% to about 10% | from about 5% to about 45% | from about 0.1% to about 3% |
| 4 | from about 20% to about 60% | from about 5% to about 25% | from about 25% to about 40% | from about 0.1% to about 5% (preferably from about 0.1% to about 3%) |
| 5 | about 40% | about 10% | from about 25% to about 55% | about 10% |
| 6 | about 35% | about 15% | | about 10% |
| 7 | about 52% | about 13% | | about 5% |
| 8 | about 50% | about 10% | | about 1.5% |

In some embodiments, LNPs occur as liposomes or lipoplexes as described in further detail below.

LNP Size

In some embodiments, LNPs have a median diameter size of from about 50 nm to about 300 nm, such as from about 50 nm to about 250 nm, for example, from about 50 nm to about 200 nm.

In some embodiments, smaller LNPs may be used. Such particles may comprise a diameter from below 0.1 um up to 100 nm such as, but not limited to, less than 0.1 um, less than 1.0 um, less than 5 um, less than 10 um, less than 15 um, less than 20 um, less than 25 um, less than 30 um, less than 35 um, less than 40 um, less than 50 um, less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 um, less than 750 um, less than 775 um, less than 800 um, less than 825 um, less than 850 um, less than 875 um, less than 900 um, less than 925 um, less than 950 um, less than 975 um, In another embodiment, nucleic acids may be delivered using smaller LNPs which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nM, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

In some embodiments, the LNP may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

In other embodiments, LNPs have a single mode particle size distribution (i.e., they are not bi- or poly-modal).

Other Components

LNPs may further comprise one or more lipids and/or other components in addition to those mentioned above.

Other lipids may be included in the liposome compositions for a variety of purposes, such as to prevent lipid oxidation or to attach ligands onto the liposome surface. Any of a number of lipids may be present in LNPs, including amphipathic, neutral, cationic, and anionic lipids. Such lipids can be used alone or in combination.

Additional components that may be present in a LNP include bilayer stabilizing components such as polyamide oligomers (see, e.g., U.S. Pat. No. 6,320,017, which is incorporated by reference in its entirety), peptides, proteins, and detergents.

Liposomes

In some embodiments, artificial nucleic acid molecule, preferably RNAs of the inventive combination (or any other nucleic acid as defined herein) are formulated as liposomes.

Cationic lipid-based liposomes are able to complex with negatively charged nucleic acids (e.g. RNAs) via electrostatic interactions, resulting in complexes that offer biocompatibility, low toxicity, and the possibility of the large-scale production required for in vivo clinical applications. Liposomes can fuse with the plasma membrane for uptake; once inside the cell, the liposomes are processed via the endocytic pathway and the nucleic acid is then released from the endosome/carrier into the cytoplasm. Liposomes have long been perceived as drug delivery vehicles because of their superior biocompatibility, given that liposomes are basically analogs of biological membranes, and can be prepared from both natural and synthetic phospholipids (Int J Nanomedicine. 2014; 9: 1833-1843).

Liposomes typically consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposomes may have one or more lipid membranes. Liposomes can be single-layered, referred to as unilamellar, or multi-layered, referred to as multilamellar.

Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains (Front Pharmacol. 2015 Dec. 1; 6:286).

Liposomes are typically present as spherical vesicles and can range in size from 20 nm to a few microns.

Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

As a non-limiting example, liposomes such as synthetic membrane vesicles may be prepared by the methods, apparatus and devices described in US Patent Publication No. US20130177638, US20130177637, US20130177636, US20130177635, US20130177634, US20130177633, US20130183375, US20130183373 and US20130183372, the contents of each of which are herein incorporated by reference in its entirety. The artificial nucleic acid molecule, preferably RNA, of the invention, (pharmaceutical) composition or kit (or any other nucleic acid, in particular RNA, as defined herein), may be encapsulated by the liposome and/or it may be contained in an aqueous core which may then be encapsulated by the liposome (see International Pub. Nos. WO2012031046, WO2012031043, WO2012030901 and WO2012006378 and US Patent Publication No. US20130189351, US20130195969 and US20130202684; the contents of each of which are herein incorporated by reference in their entirety).

In some embodiments, the artificial nucleic acid molecule, preferably RNA, of the invention (or any other nucleic acid as defined herein), may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

Lipoplexes

In some embodiments, artificial nucleic acid molecule, preferably RNAs (or any other nucleic acid as defined herein) are formulated as lipoplexes, i.e. cationic lipid bilayers sandwiched between nucleic acid layers.

Cationic lipids, such as DOTAP, (1,2-dioleoyl-3-trimethylammonium-propane) and DOTMA (N-[1-(2,3-dioleoyloxy)propyl]-N,N,N-trimethyl-ammonium methyl sulfate) can form complexes or lipoplexes with negatively charged nucleic acids to form nanoparticles by electrostatic interaction, providing high in vitro transfection efficiency.

Nanoliposomes

In some embodiments, artificial nucleic acid molecule, preferably RNAs (or any other nucleic acid as defined herein) are formulated as neutral lipid-based nanoliposomes such as 1,2-dioleoyl-sn-glycero-3-phosphatidylcholine (DOPC)-based nanoliposomes (Adv Drug Deliv Rev. 2014 February; 66: 110-116).

Emulsions

In some embodiments, artificial nucleic acid molecule, preferably RNAs (or any other nucleic acid as defined herein) are formulated as emulsions. In another embodiment, said artificial nucleic acid molecule, preferably RNAs, are formulated in a cationic oil-in-water emulsion where the emulsion particle comprises an oil core and a cationic lipid which can interact with the nucleic acid(s) anchoring the molecule to the emulsion particle (see International Pub. No. WO2012006380; herein incorporated by reference in its entirety). In some embodiments, said artificial nucleic acid molecule, preferably RNA, is formulated in a water-in-oil emulsion comprising a continuous hydrophobic phase in which the hydrophilic phase is dispersed. As a non-limiting example, the emulsion may be made by the methods described in International Publication No. WO201087791, the contents of which are herein incorporated by reference in its entirety.

(Poly-)Cationic Compounds and Carriers

In preferred embodiments, the artificial nucleic acid molecule, preferably RNA, of the invention (or any other nucleic acid as defined herein) is complexed or associated with a cationic or polycationic compound ("(poly-) cationic compound") and/or a polymeric carrier.

The term "(poly-)cationic compound" typically refers to a charged molecule, which is positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4.

Accordingly, a "(poly-)cationic compound" may be any positively charged compound or polymer, preferably a cationic peptide or protein, which is positively charged under physiological conditions, particularly under physiological conditions in vivo. A "(poly-)cationic peptide or protein" may contain at least one positively charged amino acid, or more than one positively charged amino acid, e.g. selected from Arg, His, Lys or Orn.

(Poly-)Cationic Amino Acids, Peptides and Proteins (Poly-)cationic compounds being particularly preferred agents for complexation or association of the artificial nucleic acid molecule, preferably RNA, of the invention (or any other nucleic acid as defined herein) include protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), *Antennapedia*-derived peptides (particularly from *Drosophila antennapedia*), pAntp, pIsl, FGF, Lactoferrin, Transportan, Buforin-2, Bac715-24, SynB, SynB(1), pVEC, hCT-derived peptides, SAP, or histones.

More preferably, the artificial nucleic acid molecule, preferably RNA, of the invention, (or any other nucleic acid as defined herein) is complexed with one or more polycations, preferably with protamine or oligofectamine (discussed below), most preferably with protamine. In this context protamine is particularly preferred.

Additionally, preferred (poly-)cationic proteins or peptides may be selected from the following proteins or peptides having the following total formula (III):

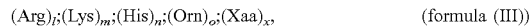

$(Arg)_l;(Lys)_m;(His)_n;(Orn)_o;(Xaa)_x,$  (formula (III))

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred cationic peptides in this context are e.g. $Arg_7$, $Arg_8$, $Arg_9$, $H_3R_9$, $R_9H_3$, $H_3R_9H_3$, $YSSR_9SSY$, $(RKH)_4$, $Y(RKH)_2R$, etc. In this context the disclosure of WO 2009/030481 is incorporated herewith by reference.

(Poly-)Cationic Polysaccharides

Further preferred (poly-)cationic compounds for complexation of or association with the artificial nucleic acid molecule, preferably RNA, of the invention (or any other nucleic acid as defined herein) include (poly-)cationic polysaccharides, e.g. chitosan, polybrene, cationic polymers, e.g. polyethyleneimine (PEI).

(Poly-)Cationic Lipids

Further preferred (poly-)cationic compounds for complexation of or association with the artificial nucleic acid molecule, preferably RNA, of the invention (or any other nucleic acid as defined herein) include (poly-)cationic lipids, e.g. DOTMA: [1-(2,3-sioleyloxy)propyl)]-N,N,N-trimethyl-ammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl-N-(alpha-trimethylammonioacetyl)diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl]trimethylammonium, CLIP9: rac-[2(2,3-dihexadecyloxypropyl-oxysuccinyloxy)ethyl]-trimethylammonium, or oligofectamine.

(Poly-)Cationic Polymers

Further preferred (poly-)cationic compounds for complexation of or association with the artificial nucleic acid molecule, preferably RNA, of the invention, (or any other nucleic acid as defined herein) include (poly-)cationic polymers, e.g. modified polyaminoacids, such as beta-amino acid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., or block polymers consisting of a combination of one or more cationic blocks (e.g. selected from a cationic polymer as mentioned above) and of one or more hydrophilic or hydrophobic blocks (e.g. polyethyleneglycole).

Polymeric Carriers

According to preferred embodiments, artificial nucleic acid molecule, preferably RNA, of the invention, ((or any other nucleic acid as defined herein) is complexed or associated with a polymeric carrier.

A "polymeric carrier" used according to the invention might be a polymeric carrier formed by disulfide-crosslinked cationic components. The disulfide-crosslinked cationic components may be the same or different from each other. The polymeric carrier can also contain further components.

It is also particularly preferred that the polymeric carrier used according to the present invention comprises mixtures of cationic peptides, proteins or polymers and optionally further components as defined herein, which are crosslinked by disulfide bonds as described herein. In this context, the disclosure of WO 2012/013326 is incorporated herewith by reference.

In this context, the cationic components, which form basis for the polymeric carrier by disulfide-crosslinkage, are typically selected from any suitable (poly-)cationic peptide, protein or polymer suitable for this purpose, particular any (poly-)cationic peptide, protein or polymer capable of complexing, and thereby preferably condensing, the artificial nucleic acid molecule, preferably RNA, of the invention (or any other nucleic acid as defined herein). The (poly-)cationic peptide, protein or polymer, is preferably a linear molecule, however, branched (poly-)cationic peptides, proteins or polymers may also be used.

Every disulfide-crosslinking (poly-)cationic protein, peptide or polymer of the polymeric carrier, which may be used to complex the artificial nucleic acid molecule, preferably RNA (or any other nucleic acid as defined herein) contains at least one —SH moiety, most preferably at least one cysteine residue or any further chemical group exhibiting an —SH moiety, capable of forming a disulfide linkage upon condensation with at least one further (poly-)cationic protein, peptide or polymer as cationic component of the polymeric carrier as mentioned herein.

As defined above, the polymeric carrier, which may be used to complex the artificial nucleic acid molecule, preferably RNA, of the invention (or any other nucleic acid as defined herein) may be formed by disulfide-crosslinked cationic (or polycationic) components. Preferably, such (poly-)cationic peptides or proteins or polymers of the polymeric carrier, which comprise or are additionally modified to comprise at least one —SH moiety, are selected from, proteins, peptides and polymers as defined herein.

In some embodiments, the polymeric carrier may be selected from a polymeric carrier molecule according to generic formula (IV):

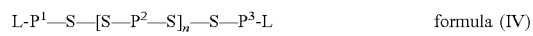

formula (IV)

wherein, $P^1$ and $P^3$ are different or identical to each other and represent a linear or branched hydrophilic polymer chain, each $P^1$ and $P^3$ exhibiting at least one —SH-moiety, capable to form a disulfide linkage upon condensation with component $P^2$, or alternatively with (AA), (AA)$_x$, or [(AA)$_x$]$_z$ if such components are used as a linker between $P^1$ and $P^2$ or $P^3$ and $P^2$) and/or with further components (e.g. (AA), (AA)$_x$, [(AA)$_x$], or L), the linear or branched hydrophilic polymer chain selected independent from each other from polyethylene glycol (PEG), poly-N-(2-hydroxypropyl) methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

$P^2$ is a (poly-)cationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20; or is a (poly-)cationic polymer, e.g. as defined above for the polymeric carrier formed by disulfide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa;

each $P^2$ exhibiting at least two —SH-moieties, capable to form a disulfide linkage upon condensation with further components $P^2$ or component(s) $P^1$ and/or $P^3$ or alternatively with further components (e.g. (AA), (AA)$_x$, or [(AA)$_x$]$_z$);

—S—S— is a (reversible) disulfide bond (the brackets are omitted for better readability), wherein S preferably represents sulphur or a —SH carrying moiety, which has formed a (reversible) disulfide bond. The (reversible) disulfide bond is preferably formed by condensation of —SH-moieties of either components $P^1$ and $P^2$, $P^2$ and $P^2$, or $P^2$ and $P^3$, or optionally of further components as defined herein (e.g. L, (AA), $(AA)_x$, $[(AA)_x]_z$, etc); The —SH-moiety may be part of the structure of these components or added by a modification as defined below;

L is an optional ligand, which may be present or not, and may be selected independent from the other from RGD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. RGD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context, the disclosure of WO 2011/026641 is incorporated herewith by reference. Each of hydrophilic polymers $P^1$ and $P^3$ typically exhibits at least one —SH-moiety, wherein the at least one —SH-moiety is capable to form a disulfide linkage upon reaction with component $P^2$ or with component (AA) or $(AA)_x$, if used as linker between $P^1$ and $P^2$ or $P^3$ and $P^2$ as defined below and optionally with a further component, e.g. L and/or (AA) or $(AA)_x$, e.g. if two or more —SH-moieties are contained. The following subformulae "$P^1$—S—S—$P^2$" and "$P^2$—S—S—$P^3$" within generic formula (IV) above (the brackets are omitted for better readability), wherein any of S, $P^1$ and $P^3$ are as defined herein, typically represent a situation, wherein one —SH-moiety of hydrophilic polymers $P^1$ and $P^3$ was condensed with one —SH-moiety of component $P^2$ of generic formula (IV) above, wherein both sulphurs of these —SH-moieties form a disulfide bond —S—S— as defined herein in formula (IV). These —SH-moieties are typically provided by each of the hydrophilic polymers $P^1$ and $P^3$, e.g. via an internal cysteine or any further (modified) amino acid or compound which carries a —SH moiety. Accordingly, the subformulae "$P^1$—S—S—$P^2$" and "$P^2$—S—S—$P^3$" may also be written as "$P^1$-Cys-Cys-$P^2$" and "$P^2$-Cys-Cys-$P^3$", if the —SH-moiety is provided by a cysteine, wherein the term Cys-Cys represents two cysteines coupled via a disulfide bond, not via a peptide bond. In this case, the term "—S—S—" in these formulae may also be written as "—S-Cys", as "-Cys-S" or as "-Cys-Cys-". In this context, the term "-Cys-Cys-" does not represent a peptide bond but a linkage of two cysteines via their —SH-moieties to form a disulfide bond. Accordingly, the term "-Cys-Cys-" also may be understood generally as "-(Cys-S)—(S-Cys)-", wherein in this specific case S indicates the sulphur of the —SH-moiety of cysteine. Likewise, the terms "—S-Cys" and "-Cys-S" indicate a disulfide bond between a —SH containing moiety and a cysteine, which may also be written as "—S—(S-Cys)" and "-(Cys-S)—S". Alternatively, the hydrophilic polymers $P^1$ and $P^3$ may be modified with a —SH moiety, preferably via a chemical reaction with a compound carrying a —SH moiety, such that each of the hydrophilic polymers $P^1$ and $P^3$ carries at least one such —SH moiety. Such a compound carrying a —SH moiety may be e.g. an (additional) cysteine or any further (modified) amino acid, which carries a —SH moiety. Such a compound may also be any non-amino compound or moiety, which contains or allows to introduce a —SH moiety into hydrophilic polymers $P^1$ and $P^3$ as defined herein. Such non-amino compounds may be attached to the hydrophilic polymers $P^1$ and $P^3$ of formula (IV) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g maleinimide moieties, α,β-unsaturated carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow $S_n$-type substitution reactions (e.g halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the SH-moiety, e.g. of a cysteine or of any further (modified) amino acid or compound, may be present at the terminal ends or internally at any position of hydrophilic polymers $P^1$ and $P^3$. As defined herein, each of hydrophilic polymers $P^1$ and $P^3$ typically exhibits at least one —SH-moiety preferably at one terminal end, but may also contain two or even more —SH-moieties, which may be used to additionally attach further components as defined herein, preferably further functional peptides or proteins e.g. a ligand, an amino acid component (AA) or $(AA)_x$, antibodies, cell penetrating peptides or enhancer peptides (e.g. TAT, KALA), etc.

Weight Ratio and N/P Ratio

In some embodiments of the invention, the artificial nucleic acid molecule, preferably RNA (or said other nucleic acid) is associated with or complexed with a (poly-)cationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of nucleic acid to (poly-) cationic compound and/or polymeric carrier; or optionally in a nitrogen/phosphate (N/P) ratio of nucleic acid to (poly-)cationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one artificial nucleic acid molecule, preferably RNA, to the one or more polycations is in the range of about 0.1 to 10, including a range of about 0.3 to 4, of about 0.5 to 2, of about 0.7 to 2 and of about 0.7 to 1.5.

The artificial nucleic acid molecule, preferably RNA, of the invention (or any other nucleic acid as defined herein) can also be associated with a vehicle, transfection or complexation agent for increasing the transfection efficiency of said artificial nucleic acid molecule, preferably RNA.

In this context, it is particularly preferred that the inventive (pharmaceutical) composition comprises the artificial nucleic acid molecule, preferably RNA that is complexed at least partially with a (poly-)cationic compound and/or a polymeric carrier, preferably cationic proteins or peptides.

In this context, the disclosure of WO 2010/037539 and WO 2012/113513 is incorporated herewith by reference. "Partially" means that only a part of said artificial nucleic acid molecule, preferably RNA is complexed with a (poly-)cationic compound and/or polymeric carrier, while the rest of said artificial nucleic acid molecule, preferably RNA is present in uncomplexed form ("free").

Preferably, the molar ratio of the complexed artificial nucleic acid molecule, preferably RNA to the free artificial nucleic acid molecule, preferably RNA is selected from a molar ratio of about 0.001:1 to about 1:0.001, including a ratio of about 1:1. More preferably the ratio of complexed artificial nucleic acid molecule, preferably RNA to free artificial nucleic acid molecule, preferably RNA is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed artificial nucleic acid molecule, preferably RNA to free artificial nucleic acid molecule, preferably RNA is selected from a ratio of about 1:1 (w/w).

The complexed artificial nucleic acid molecule, preferably RNA, of the invention is preferably prepared according to a first step by complexing the artificial nucleic acid molecule, preferably RNA with a (poly-)cationic compound and/or with a polymeric carrier, preferably as defined herein, in a specific ratio to form a stable complex. In this context, it is highly preferable, that no free (poly-)cationic compound or polymeric carrier or only a negligibly small amount thereof remains in the fraction of the complexed artificial nucleic acid molecule, preferably RNA after complexing said artificial nucleic acid molecule, preferably RNA. Accordingly, the ratio of the artificial nucleic acid molecule, preferably RNA and the (poly-)cationic compound and/or the polymeric carrier in the fraction of the complexed RNA is typically selected in a range so that the artificial nucleic acid molecule, preferably RNA is entirely complexed and no free (poly-)cationic compound or polymeric carrier or only a negligibly small amount thereof remains in said fraction.

Preferably, the ratio of the artificial nucleic acid molecule, preferably RNA, to the (poly-)cationic compound and/or the polymeric carrier, preferably as defined herein, is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w).

Alternatively, the ratio of the artificial nucleic acid molecule, preferably RNA, to the (poly-)cationic compound and/or the polymeric carrier may also be calculated on the basis of the nitrogen/phosphate ratio (N/P-ratio) of the entire complex. In the context of the present invention, an N/P-ratio is preferably in the range of about 0.1-10, preferably in a range of about 0.3-4 and most preferably in a range of about 0.5-2 or 0.7-2 regarding the ratio of artificial nucleic acid molecule, preferably RNA, to (poly-)cationic compound and/or polymeric carrier, preferably as defined herein, in the complex, and most preferably in a range of about 0.7-1.5, 0.5-1 or 0.7-1, and even most preferably in a range of about 0.3-0.9 or 0.5-0.9, preferably provided that the (poly-)cationic compound in the complex is a (poly-)cationic protein or peptide and/or the polymeric carrier as defined above.

In other embodiments, artificial nucleic acid molecule, preferably RNA, may be provided and used in free or naked form without being associated with any further vehicle, transfection or complexation agent.

Targeted Delivery

In some embodiments, (poly-)cationic compounds, carriers, liposomes or LNPs may be formulated for targeted delivery for reaching different organs and/or cell types. As a non-limiting example, the (poly-)cationic compound, carrier, liposome or LNP may be formulated for targeted delivery to the liver. The (poly-)cationic compound, carrier, liposome or LNP used for targeted delivery may include, but is not limited to, the (poly-) cationic compound, carrier, liposomes or LNPs described herein. The RNAs of the invention may encode conjugates, e.g. therapeutic proteins or fragments or variants thereof covalently linked to a carrier or targeting group.

Targeting groups can be proteins, e.g., glycoproteins, or peptides, e.g., molecules having a specific affinity for a co-ligand, or antibodies e.g., an antibody, that binds to a specified cell type such as a epithelial cell, keratinocyte or the like. Targeting groups may also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, multivalent fucose, or aptamers. The targeting group can be any ligand that is capable of targeting a specific receptor.

In some embodiments, the artificial nucleic acid molecules, preferably RNAs, and optionally (pharmaceutical) compositions or kits comprising the same, are adapted for targeting (in)to the liver. Such artificial nucleic acid molecules, preferably RNAs, and optionally (pharmaceutical) compositions or kits comprising the same, may be particularly suited for treatment, prevention or attenuation of metabolic diseases, e.g., metabolic disease caused by inborn genetic errors, e.g., ornithine transcarbamylase deficiency-related diseases.

(Pharmaceutical) Composition

In a further aspect, the present invention provides a composition comprising the artificial nucleic acid molecule, preferably RNA, according to the invention, and at least one pharmaceutically acceptable carrier or excipient. The composition according to the invention is preferably provided as a pharmaceutical composition.

The artificial nucleic acid molecule, preferably RNA, may be provided as part of the (pharmaceutical) composition in "complexed" or "free" form as described elsewhere herein, or a mixture thereof.

The (pharmaceutical) composition according to the invention may further comprise at least one gRNA, or a vector providing the same, as defined elsewhere herein.

The (pharmaceutical) composition according to the invention may further comprise at least one further active agent useful for treatment of the disease or condition that is subject to therapy with the artificial nucleic acid molecule, preferably RNA, or (pharmaceutical) composition comprising the same.

Pharmaceutically Acceptable Excipients and Carriers

Preferably, the (pharmaceutical) composition according to the invention comprises at least one pharmaceutically acceptable carrier and/or excipient. The term "pharmaceutically acceptable" refers to a compound or agent that is compatible with the one or more active agent(s) (here: artificial nucleic acid molecule, preferably RNA) and does not interfere with and/or substantially reduce their pharmaceutical activities. Pharmaceutically acceptable carriers preferably have sufficiently high purity and sufficiently low toxicity to make them suitable for administration to a subject to be treated.

Excipients

Pharmaceutically acceptable excipients can exhibit different functional roles and include, without limitation, diluents, fillers, bulking agents, carriers, disintegrants, binders, lubricants, glidants, coatings, solvents and co-solvents, buffering agents, preservatives, adjuvants, anti-oxidants, wetting agents, anti-foaming agents, thickening agents, sweetening agents, flavouring agents and humectants.

For (pharmaceutical) compositions in liquid form, useful pharmaceutically acceptable excipients in general include solvents, diluents or carriers such as (pyrogen-free) water, (isotonic) saline solutions such phosphate or citrate buffered saline, fixed oils, vegetable oils, such as, for example, groundnut oil, cottonseed oil, sesame oil, olive oil, corn oil, ethanol, polyols (for example, glycerol, propylene glycol, polyethylene glycol, and the like); lecithin; surfactants; preservatives such as benzyl alcohol, parabens, chlorobutanol, phenol, ascorbic acid, thimerosal, and the like; isotonic agents such as sugars, polyalcohols such as manitol, sorbitol, or sodium chloride; aluminum monostearate or gelatin; antioxidants such as ascorbic acid or sodium bisulfite; chelating agents such as ethylenediaminetetraacetic acid (EDTA); buffers such as acetates, citrates or phosphates and agents for the adjustment of tonicity such as sodium chloride or dextrose. pH can be adjusted with acids or bases, such as hydrochloric acid or sodium hydroxide. Buffers may be hypertonic, isotonic or hypotonic with reference to the specific reference medium, i.e. the buffer may have a higher, identical or lower salt content with reference to the specific reference medium, wherein preferably such concentrations of the aforementioned salts may be used, which do not lead to damage of cells due to osmosis or other concentration effects. Reference media are e.g. liquids occurring in "in vivo" methods, such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

For (pharmaceutical) compositions in (semi-)solid form, useful pharmaceutically acceptable excipients include binders such as microcrystalline cellulose, gum tragacanth or gelatin; starch or lactose; sugars, such as, for example, lactose, glucose and sucrose; starches, such as, for example, corn starch or potato starch; cellulose and its derivatives, such as, for example, sodium carboxymethylcellulose, ethylcellulose, cellulose acetate; disintegrants such as alginic acid; lubricants such as magnesium stearate; glidants such as stearic acid, magnesium stearate; calcium sulphate, colloidal silicon dioxide and the like; sweetening agents such as sucrose or saccharin; and/or flavoring agents such as peppermint, methyl salicylate, or orange flavoring.

Carriers

Suitable pharmaceutically acceptable carriers are typically chosen based on the formulation of the (pharmaceutical) composition.

Liquid (pharmaceutical) compositions administered via injection and in particular via i.v. injection should be sterile and stable under the conditions of manufacture and storage. Such compositions are typically formulated as parenterally acceptable aqueous solutions that are pyrogen-free, have suitable pH, are isotonic and maintain stability of the active ingredient(s).

Particularly useful pharmaceutically acceptable carriers for liquid (pharmaceutical) compositions according to the invention include water, typically pyrogen-free water; isotonic saline or buffered (aqueous) solutions, e.g phosphate, citrate etc. buffered solutions. Particularly for injection of the inventive (pharmaceutical) compositions, water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt.

According to preferred embodiments, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$, $CaI_2$, $CaBr_2$, $CaCO_3$, $CaSO_4$, $Ca(OH)_2$. Furthermore, organic anions of the aforementioned cations may be contained in the buffer.

According to more preferred embodiments, the buffer suitable for injection purposes as defined above, may contain salts selected from sodium chloride (NaCl), calcium chloride ($CaCl_2$) and optionally potassium chloride (KCl), wherein further anions may be present additional to the chlorides. $CaCl_2$) can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride ($CaCl_2$)). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

Formulation

Generally, (pharmaceutical) compositions for topical administration can be formulated as creams, ointments, gels, pastes or powders. (Pharmaceutical) compositions for oral administration can be formulated as tablets, capsules, liquids, powders or in a sustained release format. However, according to preferred embodiments, the inventive (pharmaceutical) composition is administered parenterally, in particular via intradermal or intramuscular injection, and is accordingly formulated in liquid or lyophilized form for parenteral administration as discussed elsewhere herein. Parenteral formulations are typically stored in vials, IV bags, ampoules, cartridges, or prefilled syringes and can be administered as injections, inhalants, or aerosols, with injections being preferred.

Lyophilized Formulations

In further preferred embodiments, the (pharmaceutical) composition is provided in lyophilized form. Preferably, the lyophilized (pharmaceutical) composition is reconstituted in a suitable buffer, advantageously based on an aqueous carrier, prior to administration, e.g. Ringer-Lactate solution, which is preferred, Ringer solution, a phosphate buffer solution. In some embodiments, the (pharmaceutical) composition according to the invention contains at least two, three, four, five, six or more artificial nucleic acid molecules, preferably RNAs, which are provided separately in lyophilized form (optionally together with at least one further additive) and which are preferably reconstituted separately in a suitable buffer (such as Ringer-Lactate solution) prior to their use so as to allow individual administration of each of said artificial nucleic acid molecule, preferably RNAs.

Liquid Formulations

In further preferred embodiments, the (pharmaceutical) composition is provided in the form of a saline or a lipid-based formulation. Lipid-based formulations may comprise liposomes, lipoplexes, nanoliposomes and lipid nanoparticles which are described above in the section headed "Complexation".

Kit

In a further aspect, the present invention relates to a kit or kit-of-parts comprising the artificial nucleic acid molecule, preferably RNA, and/or the (pharmaceutical) composition. The kit may further comprise at least one gRNA (or vector providing the same).

The aforementioned components may each be provided in the form of a pharmaceutical composition in the kit-of-parts. Insofar, the definitions and explanations provided above for the (pharmaceutical) composition are equally applicable to the individual components of the kit-of-parts, Mutatis mutandis.

For instance, the at least one artificial nucleic acid molecule, preferably RNA, and optionally the at least one gRNA or nucleic acid encoding the same, may be provided—independently from each other—in lyophilized or liquid form, optionally together with one or more pharmaceutically acceptable carrier(s), excipients or further agents as described above in the context of the pharmaceutical composition.

Optionally, the kit-of-parts may comprise at least one further agent as defined herein in the context of the pharmaceutical composition, antimicrobial agents, RNAse inhibitors, solubilizing agents or the like.

The kit-of-parts may be a kit of two or more parts and typically comprises the components in suitable containers. For example, each container may be in the form of vials, bottles, squeeze bottles, jars, sealed sleeves, envelopes or pouches, tubes or blister packages or any other suitable form provided the container is configured so as to prevent premature mixing of components. Each of the different components may be provided separately, or some of the different components may be provided together (i.e. in the same container).

A container may also be a compartment or a chamber within a vial, a tube, a jar, or an envelope, or a sleeve, or a blister package or a bottle, provided that the contents of one compartment are not able to associate physically with the contents of another compartment prior to their deliberate mixing by a pharmacist or physician.

The kit-of-parts may furthermore contain technical instructions with information on the administration and dosage of any of its components.

Medical Use and Treatment

The artificial nucleic acid molecule, preferably RNA, or the (pharmaceutical) composition or kit-of-parts defined herein may be used for human and also for veterinary medical purposes, preferably for human medical purposes.

According to a further aspect, the invention thus relates to the artificial nucleic acid molecule, preferably RNA, or the (pharmaceutical) composition or kit-of-parts for use as a medicament.

The artificial nucleic acid molecule, preferably RNA, or the (pharmaceutical) composition or kit-of-parts are inter alia useful for treatment and/or prophylaxis of diseases amenable to treatment by expression of the encoded CRISPR-associated protein, preferably amenable to treatment by knocking in, knocking out, manipulating or modulating the expression of a gene of interest.

According to a further aspect, the invention thus relates to the artificial nucleic acid molecule, preferably RNA, or the (pharmaceutical) composition or kit-of-parts for use in a method of gene therapy and/or for treatment of diseases amenable to treatment by expression of the encoded CRISPR-associated protein, preferably amenable to treatment by knocking in, knocking out, manipulating or modulating the expression of a gene of interest. Such diseases may be selected from genetic diseases, cancer, autoimmune diseases, inflammatory diseases, infectious diseases, metabolic diseases, neural diseases, cardiovascular diseases, or other diseases or conditions.

"Gene therapy" preferably involves modulating (i.e. restoring, enhancing, decreasing or inhibiting) gene expression in a subject in order to achieve a therapeutic effect. To this end, gene therapy typically encompasses the introduction of nucleic acids into cells. The term generally refers to the manipulation of a genome for therapeutic purposes and includes the use of genome-editing technologies for correction of mutations that cause disease, the addition of therapeutic genes to the genome, the removal of deleterious genes or genome sequences, and the modulation of gene expression. Gene therapy may involve in vivo or ex vivo transformation of the host cells.

The term "treatment" or "treating" of a disease includes preventing or protecting against the disease (that is, causing the clinical symptoms not to develop); inhibiting the disease (i.e., arresting or suppressing the development of clinical symptoms; and/or relieving the disease (i.e., causing the regression of clinical symptoms). As will be appreciated, it is not always possible to distinguish between "preventing" and "suppressing" a disease or disorder since the ultimate inductive event or events may be unknown or latent. Accordingly, the term "prophylaxis" will be understood to constitute a type of "treatment" that encompasses both "preventing" and "suppressing." The term "treatment" thus includes "prophylaxis".

The term "subject", "patient" or "individual" as used herein generally includes humans and non-human animals and preferably mammals (e.g., non-human primates, including marmosets, tamarins, spider monkeys, owl monkeys, vervet monkeys, squirrel monkeys, and baboons, macaques, chimpanzees, orangutans, gorillas; cows; horses; sheep; pigs; chicken; cats; dogs; mice; rat; rabbits; guinea pigs; etc.), including chimeric and transgenic animals and disease models. In the context of the present invention, the term "subject" preferably refers a non-human primate or a human, most preferably a human.

Accordingly, the present invention further provides methods of treating diseases amenable to treatment by expression of the encoded CRISPR-associated protein, preferably amenable to treatment by knocking in, knocking out, manipulating or modulating the expression of a gene of interest, by administering to a subject in need thereof a pharmaceutically effective amount of the artificial nucleic acid molecule, preferably RNA, or the (pharmaceutical) composition or kit-of-parts. Such methods may comprise an optional first step of preparing the inventive artificial nucleic acid molecule, preferably RNA, or the (pharmaceutical) composition or kit-of-parts, and a second step, comprising administering (a pharmaceutically and/or therapeutically effective amount of) said artificial nucleic acid molecule, preferably RNA, or the (pharmaceutical) composition or kit-of-parts to a patient/subject in need thereof.

Administration is preferably accomplished parenterally, for instance by subcutaneous, intramuscular or intradermal injection, preferably by intramuscular or intradermal injection, more preferably by intradermal injection. Preferably, injection is carried out by using conventional needle injection or (needle-free) jet injection, preferably by using (needle-free) jet injection.

The invention also relates to the use of the inventive artificial nucleic acid molecule, preferably RNA, or the (pharmaceutical) composition or kit-of-parts, preferably for knocking-in, knocking-out, manipulating or modulating, preferably for inducing or enhancing, expression of a gene of interest.

Administration Routes

The inventive artificial nucleic acid molecule, preferably RNA, or the (pharmaceutical) composition or kit-of-parts can be administered, for example, systemically or locally.

Routes for systemic administration in general include, for example, transdermal, oral, parenteral routes, including subcutaneous, intravenous, intramuscular, intraarterial, intradermal and intraperitoneal injections and/or intranasal administration routes.

Routes for local administration in general include, for example, topical administration routes but also intradermal, transdermal, subcutaneous, or intramuscular injections or intralesional, intratumoral, intracranial, intrapulmonal, intracardial, and sublingual injections.

It is further conceivable to use different administration routes for different components of the artificial nucleic acid molecule, preferably RNA, or the (pharmaceutical) composition or kit-of-parts, for instance in case said (pharmaceutical) composition or kit-of-parts comprises several different nucleic acids (such as at least one artificial nucleic acid encoding a CRISPR-associated protein and at least one gRNA or a vector providing the same).

According to preferred embodiments, the artificial nucleic acid molecule, preferably RNA, or the (pharmaceutical) composition or kit-of-parts is administered by a parenteral route, preferably via intradermal, subcutaneous, or intramuscular routes. Preferably, said artificial nucleic acid molecule, preferably RNA, or the (pharmaceutical) composition or kit-of-parts is administered by injection, e.g. subcutaneous, intramuscular or intradermal injection, which may be needle-free and/or needle injection. Accordingly, in preferred embodiments, the medical use and/or method of treatment according to the present invention involves administration of said artificial nucleic acid molecule, preferably RNA, or the (pharmaceutical) composition or kit-of-parts by subcutaneous, intramuscular or intradermal injection, preferably by intramuscular or intradermal injection, more preferably by intradermal injection. Such injection may be carried out by using conventional needle injection or (needle-free) jet injection, preferably by using (needle-free) jet injection.

Administration Regimen

The components of the inventive (pharmaceutical) composition or kit-of-parts—i.e., the at least one artificial nucleic acid molecule, preferably RNA, and optionally at least one other nucleic acid (e.g. gRNA or vector providing the same) may be administered to a subject in need thereof several times a day, daily, every other day, weekly, or monthly; and may be administered sequentially or simultaneously. Said components may be administered to a subject in need thereof via different administration routes as defined above.

According to some preferred embodiments, the components of the inventive, (pharmaceutical) composition are administered simultaneously (i.e. at the same time via the same or different administrations routes).

According to other preferred embodiments, the components of the inventive (pharmaceutical) composition or kit-of-parts are administered separately (i.e. sequentially at different time points and/or via different administrations routes). Such a sequential administration scheme is also referred to as "time-staggered" administration. Time-staggered administration may mean that the artificial nucleic acid molecule, preferably RNA is administered e.g. prior, concurrent or subsequent to the gRNA or vector providing the same, or vice versa.

Dose

The inventive artificial nucleic acid molecule, preferably RNA, (pharmaceutical) composition or kit is preferably administered in a safe and therapeutically effective amount.

As used herein, "safe and therapeutically effective amount" means an amount of the active agent(s) that is sufficient to elicit a desired biological or medicinal response in a tissue, system, animal or human that is being sought. A safe and therapeutically effective amount is preferably sufficient for the inducing a positive modification of the disease to be treated, i.e. for alleviation of the symptoms of the disease being treated, reduction of disease progression, or prophylaxis of the symptoms of the disease being prevented. At the same time, however, a "safe and therapeutically effective amount" is small enough to avoid serious side-effects, that is to say to permit a sensible relationship between advantage and risk.

A "safe and therapeutically effective amount" will furthermore vary in connection with the particular condition to be treated and also with the age, physical condition, body weight, sex and diet of the patient to be treated, the severity of the condition, the duration of the treatment, the nature of the accompanying therapy, of the particular pharmaceutically acceptable carrier or excipient used, the treatment regimen and similar factors. A "safe and (therapeutically) effective amount" of the artificial nucleic acid molecule, preferably RNA, may furthermore be selected depending on the type of artificial nucleic acid molecule, preferably RNA, e.g. monocistronic, bi- or even multicistronic RNA, since a bi- or even multicistronic RNA may lead to a significantly higher expression of the encoded CRISPR-associated protein(s) than the use of an equal amount of a monocistronic RNA.

Therapeutic efficacy and toxicity of inventive artificial nucleic acid molecule, preferably RNA, (pharmaceutical) composition or kit-of-parts can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and can be expressed as the ratio LD50/ED50. Artificial nucleic acids, preferably RNAs, (pharmaceutical) compositions or kit-of-parts which exhibit large therapeutic indices are generally preferred. The data obtained from the cell culture assays and animal studies can be used in formulating a range of dosage for use in humans. The dosage of such compounds lies preferably within a range of circulating concentrations that include the ED50 with little or no toxicity.

For instance, therapeutically effective doses of the inventive artificial nucleic acid molecule, preferably RNA, (pharmaceutical) composition or kit-of-parts described herein may range from about 0.001 mg to 10 mg, preferably from about 0.01 mg to 5 mg, more preferably from about 0.1 mg to 2 mg per dosage unit or from about 0.01 nmol to 1 mmol per dosage unit, in particular from 1 nmol to 1 mmol per dosage unit, preferably from 1 µmol to 1 mmol per dosage unit. It is also envisaged that the therapeutically effective dose of the inventive artificial nucleic acid molecule, preferably RNA, (pharmaceutical) composition or kit-of-parts may range (per kg body weight) from about 0.01 mg/kg to 10 g/kg, preferably from about 0.05 mg/kg to 5 g/kg, more preferably from about 0.1 mg/kg to 2.5 g/kg.

Safe and therapeutically effective amounts of the inventive artificial nucleic acid molecule, preferably RNA, (pharmaceutical) composition or kit-of-parts to be administered can be determined by routine experiments, e.g. by using animal models. Such models include, without implying any limitation, rabbit, sheep, mouse, rat, dog and non-human primate models.

Diseases

CRISPR technologies can be employed for a variety of purposes, including functional knockout or knock-in of genes, gene editing or transcriptional activation or inhibition. The artificial nucleic acid molecule, preferably RNA, (pharmaceutical) composition or kit according to the invention can therefore be used for treating a variety of diseases. It is particularly envisaged for use in gene therapy in a disease, disorder or condition amenable to treatment by expression of a CRISPR-associated protein encoded by the at least one coding sequence of the artificial nucleic acid molecule.

Preferably, the disease to be treated is amenable to treatment by knocking in, knocking out or manipulating (e.g. introducing or removing a mutation) of a gene of interest, or by modulating (i.e. altering, inducing, increasing, reducing, preventing or disrupting) its expression.

Artificial nucleic acid molecules, preferably RNAs, according to the invention, or (pharmaceutical) compositions or kits comprising the same may be used to induce gene knockouts (i.e. render genes non-functional or remove genes from the genome). Therefore, artificial nucleic acid molecules, preferably RNAs, encoding CRISPR-associated proteins exhibiting endonuclease activity may be utilized, which are capable of introducing DSBs into the genomic DNA. Said DSBs may induce non-homologous end-joining (NHEJ), resulting in the random insertion or deletion of short stretches of nucleotides leading to the disruption of the codon-reading frame (frameshifts), resulting in erroneous transcripts and ablation of gene expression (loss-of-function). This strategy may for instance be useful for knocking-out genes that mediate tumor cell proliferation and survival, or for removing integrated viral from the host cell's genome.

Artificial nucleic acid molecules, preferably RNAs, according to the invention, or (pharmaceutical) compositions or kits comprising the same may be used to induce gene knockins (i.e. introduce new or modified genes into the genome). Therefore, artificial nucleic acid molecules, preferably RNAs, encoding CRISPR-associated proteins exhibiting nickase activity may be utilized, which are thus capable of introducing nicks (i.e. hydrolysis of the phosphodiester bonds of one strand of the double-stranded genomic DNA) into the genomic DNA. Such nicks preferably induce homology directed repair (HDR), resulting in the incorporation of a DNA segment with regions having homology to the sequences flanking both sides of the DNA double strand break. Using HDR, any desired DNA sequence can be inserted into the genomic DNA to induce, for example, loss of function, gain of function or altered (neomorphic) function or to investigate variants of unknown functional status. To utilize HDR to edit the genome, a DNA repair template with the desired sequence is typically provided together with the artificial nucleic acid of the invention (and the gRNA). This strategy may for instance be useful for knocking-in therapeutic genes.

Artificial nucleic acid molecules, preferably RNAs, according to the invention, or (pharmaceutical) compositions or kits comprising the same may be used to modulate gene expression, and in particular gene transcription. Therefore, artificial nucleic acid molecules, preferably RNAs, encoding CRISPR-associated protein derivatives comprising suitable effector domains may be utilized. The effector domains may interact with a target gene (or a regulatory sequence operably linked thereto) to modulate its expression. This approach is may be useful for any disease that is associated with an undesired (present or absent, increased or decreased) expression of a target gene of interest.

Cancer

In preferred embodiments, the artificial nucleic acid, preferably RNA, (pharmaceutical) composition or kit is used for treatment or prophylaxis of cancer.

As used herein, the term "cancer" refers to a neoplasm characterized by the uncontrolled and usually rapid proliferation of cells that tend to invade surrounding tissue and to metastasize to distant body sites. The term encompasses benign and malignant neoplasms. Malignancy in cancers is typically characterized by anaplasia, invasiveness, and metastasis; whereas benign malignancies typically have none of those properties. The terms includes neoplasms characterized by tumor growth as well as cancers of blood and lymphatic system.

In some embodiments, the artificial nucleic acid, preferably RNA, (pharmaceutical) composition or kit according to the invention may be used as a medicament, in particular for treatment of tumor or cancer diseases. In this context, treatment preferably involves intratumoral application, especially by intratumoral injection. Accordingly, the artificial nucleic acid, preferably RNA, (pharmaceutical) composition or kit according to the invention may be used for preparation of a medicament for treatment of tumor or cancer diseases, said medicament being particularly suitable for intratumoral application (administration) for treatment of tumor or cancer diseases.

Preferably, tumor and cancer diseases as mentioned herein are selected from tumor or cancer diseases which preferably include e.g. Acute lymphoblastic leukemia, Acute myeloid leukemia, Adrenocortical carcinoma, AIDS-related cancers, AIDS-related lymphoma, Anal cancer, Appendix cancer, Astrocytoma, Basal cell carcinoma, Bile duct cancer, Bladder cancer, Bone cancer, Osteosarcoma/Malignant fibrous histiocytoma, Brainstem glioma, Brain tumor, cerebellar astrocytoma, cerebral astrocytoma/malignant glioma, ependymoma, medulloblastoma, supratentorial primitive neuroectodermal tumors, visual pathway and hypothalamic glioma, Breast cancer, Bronchial adenomas/carcinoids, Burkitt lymphoma, childhood Carcinoid tumor, gastrointestinal Carcinoid tumor, Carcinoma of unknown primary, primary Central nervous system lymphoma, childhood Cerebellar astrocytoma, childhood Cerebral astrocytoma/Malignant glioma, Cervical cancer, Childhood cancers, Chronic lymphocytic leukemia, Chronic myelogenous leukemia, Chronic myeloproliferative disorders, Colon Cancer, Cutaneous T-cell lymphoma, Desmoplastic small round cell tumor, Endometrial cancer, Ependymoma, Esophageal cancer, Ewing's sarcoma in the Ewing family of tumors, Childhood Extracranial germ cell tumor, Extragonadal Germ cell tumor, Extrahepatic bile duct cancer, Intraocular melanoma, Retinoblastoma, Gallbladder cancer, Gastric (Stomach) cancer, Gastrointestinal Carcinoid Tumor, Gastrointestinal stromal tumor (GIST), extracranial, extragonadal, or ovarian Germ cell tumor, Gestational trophoblastic tumor, Glioma of the brain stem, Childhood Cerebral Astrocytoma, Childhood Visual Pathway and Hypothalamic Glioma, Gastric carcinoid, Hairy cell leukemia, Head and neck cancer, Heart cancer, Hepatocellular (liver) cancer, Hodgkin lymphoma, Hypopharyngeal cancer, childhood Hypothalamic and visual pathway glioma, Intraocular Melanoma, Islet Cell Carcinoma (Endocrine Pancreas), Kaposi sarcoma, Kidney cancer (renal cell cancer), Laryngeal Cancer, Leukemias, acute lymphoblastic Leukemia, acute myeloid Leukemia, chronic lymphocytic Leukemia, chronic myelogenous Leukemia, hairy cell Leukemia, Lip and Oral Cavity Cancer, Liposarcoma, Liver Cancer, Non-Small Cell Lung Cancer, Small Cell Lung Cancer, Lymphomas, AIDS-related Lymphoma, Burkitt Lymphoma, cutaneous T-Cell Lymphoma, Hodgkin Lymphoma, Non-Hodgkin Lymphomas, Primary Central Nervous System Lymphoma, Waldenström Macroglobulinemia, Malignant Fibrous Histiocytoma of Bone/Osteosarcoma, Childhood Medulloblastoma, Melanoma, Intraocular (Eye) Melanoma, Merkel Cell Carcinoma, Adult Malignant Mesothelioma, Childhood Mesothelioma, Metastatic Squamous Neck Cancer with Occult Primary, Mouth Cancer, Childhood Multiple Endocrine Neoplasia Syndrome, Multiple Myeloma/Plasma Cell Neoplasm, Mycosis Fungoides, Myelodysplastic Syndromes, Myelodysplastic/Myeloproliferative Diseases, Chronic Myelogenous Leukemia, Adult Acute Myeloid Leukemia, Childhood Acute Myeloid Leukemia, Multiple Myeloma (Cancer of the Bone-Marrow), Chronic Myeloproliferative Disorders, Nasal cavity and paranasal sinus cancer, Nasopharyngeal carcinoma, Neuroblastoma, Oral Cancer, Oropharyngeal cancer, Osteosarcoma/malignant fibrous histiocytoma of bone, Ovarian cancer, Ovarian epithelial cancer (Surface epithelial-stromal tumor), Ovarian germ cell tumor, Ovarian low malignant potential tumor, Pancreatic cancer, islet cell Pancreatic cancer, Paranasal sinus and nasal cavity cancer, Parathyroid cancer, Penile cancer, Pharyngeal cancer, Pheochromocytoma, Pineal astrocytoma, Pineal germinoma, childhood Pineoblastoma and supratentorial primitive neuroectodermal tumors, Pituitary adenoma, Plasma cell neoplasia/Multiple myeloma, Pleuropulmonary blastoma, Primary central nervous system lymphoma, Prostate cancer, Rectal cancer, Renal cell carcinoma (kidney cancer), Cancer of the Renal pelvis and ureter, Retinoblastoma, childhood Rhabdomyosarcoma, Salivary gland cancer, Sarcoma of the Ewing family of tumors, Kaposi Sarcoma, soft tissue Sarcoma, uterine Sarcoma, Sézary syndrome, Skin cancer (non-melanoma), Skin cancer (melanoma), Merkel cell Skin carcinoma, Small intestine cancer, Squamous cell carcinoma, metastatic Squamous neck cancer with occult primary, childhood Supratentorial primitive neuroectodermal tumor, Testicular cancer, Throat cancer, childhood Thymoma, Thymoma and Thymic carcinoma, Thyroid cancer, childhood Thyroid cancer, Transitional cell cancer of the renal pelvis and ureter, gestational Trophoblastic tumor, Urethral cancer, endometrial Uterine cancer, Uterine sarcoma, Vaginal cancer, childhood Visual pathway and hypothalamic glioma, Vulvar cancer, Waldenström macroglobulinemia, and childhood Wilms tumor (kidney cancer).

Especially preferred examples of tumors or cancers that are suitable for intratumoral administration are prostate cancer, lung cancer, breast cancer, brain cancer, head and neck cancer, thyroid cancer, colon cancer, stomach cancer, liver cancer, pancreas cancer, ovary cancer, skin cancer, urinary bladder, uterus and cervix.

Infectious Diseases

The inventive combination, pharmaceutical composition or kit may be used for treating infectious diseases. The term "infection" or "infectious disease" relates to the invasion and multiplication of microorganisms such as bacteria, viruses, and parasites that are not normally present within the body. An infection may cause no symptoms and be subclinical, or it may cause symptoms and be clinically apparent. An infection may remain localized, or it may spread through the blood or lymphatic system to become systemic. Infectious diseases in this context, preferably include viral, bacterial, fungal or protozoological infectious diseases.

The inventive artificial nucleic acids, preferably RNAs, are considered particularly useful for removing viral genomes integrated into the host cell's genome. Eradication of viruses from host cells by CRISPR-associated proteins encoded by the artificial nucleic acids, preferably RNAs, of the invention is preferably applicable to any DNA virus or RNA virus that has a DNA intermediate in its life cycle. Therefore, the artificial nucleic acids, preferably RNAs, (pharmaceutical) compositions and kits according to the invention are particularly envisaged for treatment of Human Papillomaviruses HPV16 and HPV18 infection, Hepatitis B virus (HBV) infection, Epstein-Barr virus (EBV), HIV-1 infection, Herpesvirus infection (including Kaposi's sarcoma-associated herpesvirus (KSHV, HHV8) infection), and Polyomavirus infection (including Merkel cell carcinoma virus (MCV), polyomavirus JC (JCV) and polyomavirus BK (BKV) infection, and associated infectious diseases.

Combination Therapy

The inventive artificial nucleic acid molecule, preferably RNA, (pharmaceutical) composition or kit-of-parts may also be used in combination therapy. Any other therapy useful for treating or preventing the diseases and disorders defined herein may be combined with the uses and methods disclosed herein.

For instance, the subject receiving the inventive artificial nucleic acid molecule, preferably RNA, (pharmaceutical) composition or kit-of-parts may be a patient with cancer, preferably as defined herein, or a related condition, receiving chemotherapy (e.g. first-line or second-line chemotherapy), radiotherapy, chemoradiation (combination of chemotherapy and radiotherapy), tyrosine kinase inhibitors (e.g. EGFR tyrosine kinase inhibitors), antibody therapy and/or inhibitory and/or stimulatory checkpoint molecules (e.g. CTLA4 inhibitors), or a patient, who has achieved partial response or stable disease after having received one or more of the treatments specified above. Or, the subject receiving the inventive artificial nucleic acid molecule, preferably RNA, (pharmaceutical) composition or kit-of-parts may be a patient with an infectious disease, preferably as defined herein, receiving antibiotic, antifungal or antiviral therapy.

In a further aspect, the present invention thus also relates to the use of the inventive artificial nucleic acid molecule, preferably RNA, (pharmaceutical) composition or kit-of-parts for supporting another therapy of cancer, an infectious disease, or any other disease amenable by treatment with said artificial nucleic acid molecule, (pharmaceutical) composition or kit.

"Support" of the treatment or prophylaxis of cancer may be any combination of a conventional cancer therapy method of such as surgery, radiation therapy, chemotherapy (e.g. first-line or second-line chemotherapy), chemoradiation, treatment with tyrosine kinase inhibitors, treatment with inhibitory and/or stimulatory checkpoint molecules, preferably CTLA4 inhibitors, antibody therapy or any combination of these, and a therapy using the inventive artificial nucleic acid molecule, preferably RNA, (pharmaceutical) composition or kit-of-parts as defined herein.

Administration of the inventive artificial nucleic acid molecule, preferably RNA, (pharmaceutical) composition or kit-of-parts may be accomplished prior to, simultaneously and/or subsequently to administering another therapeutic or subjecting the patient to another therapy that is useful for treatment of the particular disease or condition to be treated.

Items

In view of the above, the invention may be characterized by the following items:

1. An artificial nucleic acid molecule comprising
   a. at least one coding region encoding at least one CRISPR-associated protein;
   b. at least one 5' untranslated region (5' UTR) element derived from a 5' UTR of a gene selected from the group consisting of ATP5A1, RPL32, HSD17B4, SLC7A3, NOSIP, ASAH1, RPL31, TUBB4B, UBQLN2, MP68 and NDUFA4; and
   c. at least one 3' untranslated region (3' UTR) element derived from a 3' UTR of a gene selected from the group consisting of GNAS, CASP1, PSMB3, ALB, COX6B1, NDUFA1 and RPS9.
2. The artificial nucleic acid molecule according to item 1, wherein each of said genes comprises the naturally occurring DNA sequence, and homologs, variants, fragments, and corresponding RNA sequences thereof.
3. The artificial nucleic acid molecule according to item 1 or 2, comprising
   a. at least one 5' UTR element derived from a 5'UTR of a HSD17B4 gene, or from a corresponding RNA sequence, homolog, fragment or variant thereof and at least one 3' UTR element derived from a 3'UTR of a GNAS gene, or from a corresponding RNA sequence, homolog, fragment or variant thereof; or
   b. at least one 5' UTR element derived from a 5'UTR of a SLC7A3 gene, or from a corresponding RNA sequence, homolog, fragment or variant thereof and at least one 3' UTR element derived from a 3'UTR of a GNAS gene, or from a corresponding RNA sequence, homolog, fragment or variant thereof; or
   c. at least one 5' UTR element derived from a 5'UTR of a ATP5A1 gene, or from a corresponding RNA sequence, homolog, fragment or variant thereof and at least one 3' UTR element derived from a 3'UTR of a CASP1 gene, or from a corresponding RNA sequence, homolog, fragment or variant thereof; or
   d. at least one 5' UTR element derived from a 5'UTR of a NDUFA4 gene, or from a corresponding RNA sequence, homolog, fragment or variant thereof and at least one 3' UTR element derived from a 3'UTR of a PSMB3 gene, or from a corresponding RNA sequence, homolog, fragment or variant thereof; or
   e. at least one 5' UTR element derived from a 5'UTR of a HSD17B4 gene, or from a corresponding RNA sequence, homolog, fragment or variant thereof and at least one 3' UTR element derived from a 3'UTR of a PSMB3 gene, or from a corresponding RNA sequence, homolog, fragment or variant thereof; or
   f. at least one 5' UTR element derived from a 5'UTR of a RPL32 gene, or from a corresponding RNA sequence, homolog, fragment or variant thereof and at least one 3' UTR element derived from a 3'UTR of a ALB gene, or from a corresponding RNA sequence, homolog, fragment or variant thereof; or
   g. at least one 5' UTR element derived from a 5'UTR of a HSD17B4 gene, or from a corresponding RNA sequence, homolog, fragment or variant thereof and at least one 3' UTR element derived from a 3'UTR of a CASP1 gene, or from a corresponding RNA sequence, homolog, fragment or variant thereof; or
   h. at least one 5' UTR element derived from a 5'UTR of a SLC7A3 gene, or from a corresponding RNA sequence, homolog, fragment or variant thereof and at least one 3' UTR element derived from a 3'UTR of a CASP1 gene, or from a corresponding RNA sequence, homolog, fragment or variant thereof; or
   i. at least one 5' UTR element derived from a 5'UTR of a SLC7A3 gene, or from a corresponding RNA sequence, homolog, fragment or variant thereof and at least one 3' UTR element derived from a 3'UTR of a PSMB3 gene, or from a corresponding RNA sequence, homolog, fragment or variant thereof; or
   j. at least one 5' UTR element derived from a 5'UTR of a NOSIP gene, or from a corresponding RNA sequence, homolog, fragment or variant thereof and at least one 3' UTR element derived from a 3'UTR of a PSMB3 gene, or from a corresponding RNA sequence, homolog, fragment or variant thereof; or
   k. at least one 5' UTR element derived from a 5'UTR of a NDUFA4 gene, or from a corresponding RNA sequence, homolog, fragment or variant thereof and at least one 3' UTR element derived from a 3'UTR of a RPS9 gene, or from a corresponding RNA sequence, homolog, fragment or variant thereof; or
   l. at least one 5' UTR element derived from a 5'UTR of a HSD17B4 gene, or from a corresponding RNA sequence, homolog, fragment or variant thereof and at least one 3' UTR element derived from a 3'UTR of a RPS9 gene, or from a corresponding RNA sequence, homolog, fragment or variant thereof; or
   m. at least one 5' UTR element derived from a 5'UTR of a ATP5A1 gene, or from a homolog, a fragment or a variant thereof and at least one 3' UTR element derived from a 3'UTR of a GNAS gene, or from a homolog, a fragment or a variant thereof; or
   n. at least one 5' UTR element derived from a 5'UTR of a NDUFA4 gene, or from a homolog, a fragment or a variant thereof and at least one 3' UTR element derived from a 3'UTR of a COX6B1 gene, or from a homolog, a fragment or a variant thereof; or
   n. at least one 5' UTR element derived from a 5'UTR of a NDUFA4 gene, or from a homolog, a fragment or a variant thereof and at least one 3' UTR element derived from a 3'UTR of a GNAS gene, or from a homolog, a fragment or a variant thereof; or
   o. at least one 5' UTR element derived from a 5'UTR of a NDUFA4 gene, or from a homolog, a fragment or a variant thereof and at least one 3' UTR element derived from a 3'UTR of a NDUFA1 gene, or from a homolog, a fragment or a variant thereof; or
   p. at least one 5' UTR element derived from a 5'UTR of a NOSIP gene, or from a homolog, a fragment or a variant thereof and at least one 3' UTR element derived from a 3'UTR of a NDUFA1 gene, or from a homolog, a fragment or a variant thereof; or q. at least one 5' UTR element derived from a 5'UTR of a RPL31 gene, or from a homolog, a fragment or a variant thereof and at least one 3' UTR element derived from a 3'UTR of a GNAS gene, or from a homolog, a fragment or a variant thereof; or r. at least one 5' UTR element derived from a 5'UTR of a TUBB4B gene, or from a homolog, a fragment or a variant thereof and at least one 3' UTR element derived from a 3'UTR of a RPS9 gene, or from a homolog, a fragment or a variant thereof; or s. at least one 5' UTR element derived from a 5'UTR of a UBQLN2 gene, or from a homolog, a fragment or a variant thereof and at least one 3' UTR element derived from a 3'UTR of a RPS9 gene, or from a homolog, a fragment or a variant thereof;

t. at least one 5' UTR element derived from a 5'UTR of a MP68 gene, or from a homolog, a fragment or a variant thereof and at least one 3' UTR element derived from a 3'UTR of a GNAS gene, or from a homolog, a fragment or a variant thereof; or u. at least one 5' UTR element derived from a 5'UTR of a MP68 gene, or from a homolog, a fragment or a variant thereof and at least one 3' UTR element derived from a 3'UTR of a NDUFA1 gene, or from a homolog, a fragment or a variant thereof.

4. The artificial nucleic acid molecule according to item 3, comprising UTR elements according to d, e, g, or l.

5. The artificial nucleic acid molecule according to any one of items 1 to 4, wherein said 5'UTR element derived from a HSD17B4 gene comprises or consists of a DNA sequence according to SEQ ID NO: 1 or a DNA sequence having, in increasing order of preference, at least 50%, 60%, 70%, 80%, 90%, 95%, 96%, 97%, 98%, or 99% sequence identity to the nucleic acid sequence according to SEQ ID NO: 1, or a fragment or a variant thereof; or an RNA sequence according to SEQ ID NO: 2, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 2, or a fragment or a variant thereof;

said 5'UTR element derived from a RPL32 gene comprises or consists of a DNA sequence according to SEQ ID NO: 21 or a DNA sequence having, in increasing order of preference, at least 50%, 60%, 70%, 80%, 90%, 95%, 96%, 97%, 98%, or 99% sequence identity to the nucleic acid sequence according to SEQ ID NO: 21, or a fragment or variant thereof; or an RNA sequence according to SEQ ID NO: 22, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 22, or a fragment or a variant thereof;

said 5'UTR element derived from a NDUFA4 gene comprises or consists of a DNA sequence according to SEQ ID NO: 9, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 9, or a fragment or variant thereof; or an RNA sequence according to SEQ ID NO: 10, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 10, or a fragment or a variant thereof;

said 5'UTR element derived from a SLC7A3 gene comprises or consists of a DNA sequence according to SEQ ID NO: 15, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 15, or a fragment or variant thereof; or an RNA sequence according to SEQ ID NO: 16, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 16, or a fragment or a variant thereof;

said 5'UTR element derived from a NOSIP gene comprises or consists of a DNA sequence according to SEQ ID NO: 11, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 11, or a fragment or variant thereof; or an RNA sequence according to SEQ ID NO: 12, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 12, or a fragment or a variant thereof;

said 5'UTR element derived from a ATP5A1 gene comprises or consists of a DNA sequence according to SEQ ID NO: 5, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 5, or a fragment or variant thereof; or an RNA sequence according to SEQ ID NO: 6, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 6, or a fragment or a variant thereof;

said 5'UTR element derived from a ASAH1 gene comprises or consists of a DNA sequence according to SEQ ID NO: 3, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 3, or a fragment or variant thereof; or an RNA sequence according to SEQ ID NO: 4, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 4, or a fragment or a variant thereof;

said 5'UTR element derived from a Mp68 gene comprises or consists of a DNA sequence according to SEQ ID NO: 7, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 7, or a fragment or variant thereof; or an RNA sequence according to SEQ ID NO: 8, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 8, or a fragment or a variant thereof;

said 5'UTR element derived from a Rpl31 gene comprises or consists of a DNA sequence according to SEQ ID NO: 13, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 13, or a fragment or variant thereof; or an RNA sequence according to SEQ ID NO: 14, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 14, or a fragment or a variant thereof;

said 5'UTR element derived from a TUBB4B gene comprises or consists of a DNA sequence according to SEQ ID NO: 17, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 17, or a fragment or variant thereof; or an RNA sequence according to SEQ ID NO: 18, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 18, or a fragment or a variant thereof;

said 5'UTR element derived from a Ubqln2 gene comprises or consists of a DNA sequence according to SEQ ID NO: 19, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 19, or a fragment or variant thereof; or an RNA sequence according to SEQ ID NO: 20, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 20, or a fragment or a variant thereof;

said 3'UTR element derived from a GNAS gene comprises or consists of a DNA sequence according to SEQ ID NO: 29, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 29, or a fragment or variant thereof; an RNA sequence according to SEQ ID NO: 30, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 30, or a fragment or a variant thereof;

said 3'UTR element derived from a CASP1 gene comprises or consists of a DNA sequence according to SEQ ID NO: 25, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 25, or a fragment or variant thereof; or an RNA sequence according to SEQ ID NO: 26, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 26, or a fragment or a variant thereof;

said 3'UTR element derived from a PSMB3 gene comprises or consists of a DNA sequence according to SEQ ID NO: 23, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 23, or a fragment or variant thereof; or an RNA sequence according to SEQ ID NO: 24, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 24, or a fragment or a variant thereof;

said 3'UTR element derived from a ALB gene comprises or consists of a DNA sequence according to SEQ ID NO: 35, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 35, or a fragment or variant thereof; or an RNA sequence according to SEQ ID NO: 36, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 36, or a fragment or a variant thereof;

said 3'UTR element derived from a RPS9 gene comprises or consists of a DNA sequence according to SEQ ID NO: 33, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 33, or a fragment or variant thereof; or an RNA sequence according to SEQ ID NO: 34, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 34, or a fragment or a variant thereof;

said 3'UTR element derived from a COX6B1 gene comprises or consists of a DNA sequence according to SEQ ID NO: 27, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 27, or a fragment or variant thereof; or an RNA sequence according to SEQ ID NO: 28, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 28, or a fragment or a variant thereof; or said 3'UTR element derived from a Ndufa1 gene comprises or consists of a DNA sequence according to SEQ ID NO: 31, or a DNA sequence having, in increasing order of preference, at least 50%, 60%, 70%, 80%, 90%, 95%, 96%, 97%, 98%, or 99% sequence identity to the nucleic acid sequence according to SEQ ID NO: 31, or a fragment or variant thereof; or an RNA sequence according to SEQ ID NO: 32, or an RNA sequence having, in increasing order of preference, at least 50%, 60%, 70%, 80%, 90%, 95%, 96%, 97%, 98%, or 99% sequence identity to the nucleic acid sequence according to SEQ ID NO: 32, or a fragment or a variant thereof.

6. The artificial nucleic acid molecule according to any one of items 1 to 5, wherein the CRISPR-associated protein comprises CRISPR-associated wild-type proteins, homologs, variants, fragments and derivatives thereof.

7. The artificial nucleic acid molecule according to any one of items 1 to 6, wherein said CRISPR-associated protein is selected from Cas9, Cpf1 (Cas12), C2c1, C2c3, Cas13, CasX or CasY.

8. The artificial nucleic acid molecule according to any one of items 1 to 7, said artificial nucleic acid comprising a nucleic acid sequence encoding a CRISPR-associated protein comprising or consisting of an amino acid sequence according to any one of SEQ ID NOs: 428-441; 10999-11001; 442-1345, or an amino acid sequence having, in increasing order of preference, at least 50%, 60%, 70%, 80%, 90%, 95%, 96%, 97%, 98%, or 99% sequence identity to the amino acid sequence according to any one of SEQ ID NOs: 428-441; 10999-11001; 442-1345, or a variant or fragment of any of these sequences.

9. The artificial nucleic acid molecule according to item 8, wherein said CRISPR-associated protein derivatives comprise at least one further effector domain, optionally selected from KRAB, CSD, WRPW, VP64, p65AD and Mxi.

10. The artificial nucleic acid molecule according to any one of items 1 to 9 wherein said artificial nucleic acid further comprises at least one nucleic acid sequence encoding a nuclear localization signal (NLS), optionally selected from an NLS comprising or consisting of an amino acid sequence according to SEQ ID NO: 426; 427; 10575; 381; 382; 384; 11957; 11958-11964, or an amino acid sequence having, in increasing order of preference, at least 50%, 60%, 70%, 80%, 90%, 95%, 96%, 97%, 98%, or 99% sequence identity to the amino acid sequence according to SEQ ID NO: 426; 427; 10575; 381; 382; 384; 11957; 11958-11964, and an NLS comprising or consisting of an amino acid sequence according to SEQ ID NO: 426; 427; 10575; 381; 382; 384; 11957; 11958-11964, or an amino acid sequence having, in increasing order of preference, at least 50%, 60%, 70%, 80%, 90%, 95%, 96%, 97%, 98%, or 99% sequence identity to the amino acid sequence according to SEQ ID NO: 426; 427; 10575; 381; 382; 384; 11957; 11958-11964 or a NLS having an amino acid sequence having, in increasing order of preference, at least 50%, 60%, 70%, 80%, 90%, 95%, 96%, 97%, 98%, or 99% sequence identity to the amino acid sequence according to: 12021-14274.

11. The artificial nucleic acid molecule according to any one of items 1 to 10, wherein said artificial nucleic acid further comprises at least one nucleic acid sequence encoding a protein or peptide tag.

12. The artificial nucleic acid molecule according to any one of items 1 to 11, wherein the at least one coding region of said artificial nucleic acid molecule comprises or consists of a nucleic acid sequence according to any one of SEQ ID NO: 411; 2540-2553; 11117-11119; 11355-11357; 2554-3457; 1380-1393; 3700-3713; 4860-4873; 6020-6033; 7180-7193; 8340-8353; 11237-11239; 11473-11475; 11591-11593; 11709-11711; 11827-11829; 11945-11947; 1394-2297; 3714-4617; 4874-5777; 6034-6937; 7194-8097; 8354-9257; 412; 3474-3887 2314-2327; 4634-4647; 5794-5807; 6954-6967; 8114-8127; 413-425; 3490-3503; 3506-3519; 3522-3535; 3538-3551; 3554-3567; 3570-3583; 3586-3599; 3602-3615; 3618-3631; 3634-3647; 3650-3663; 3666-3679; 3682-3695; 9514-9527; 9626-9639; 9738-9751; 9850-9863; 9962-9975; 10074-10087; 10186-10199; 10298-10311; 2330-2343; 2346-2359; 2362-2375; 2378-2391; 2394-2407; 2410-2423; 2426-2439; 2442-2455; 2458-2471; 2474-2487; 2490-2503; 2506-2519; 2522-2535; 9498-9511; 9610-9623; 9722-9735; 9834-9847; 9946-9959; 10058-10071; 10170-10183-10282-10295; 4650-4663; 4666-4679; 4682-4695; 4698-4711; 4714-4727; 4730-4743; 4746-4759; 4762-4775; 4778-4791; 4794-4807; 4810-4823; 4826-4839; 4842-4855; 9530-9543; 9642-9655; 9754-9767; 9866-9879; 9978-9991; 10090-10103; 10202-10215; 10314-10327; 5810-5823; 5826-5839; 5842-5855; 5858-5871; 5874-5887; 5890-5903; 5906-5919; 5922-5935; 5938-5951; 5954-5967; 5970-5983; 5986-5999; 6002-6015; 9546-9559; 9658-9671; 9770-9783; 9882-9895; 9994-10007; 10106-10119; 10218-10231; 10330-10343; 6970-6983; 6986-6999; 7002-7015; 7018-7031; 7034-7047; 7050-7063; 7066-7079; 7082-7095; 7098-7111; 7114-7127; 7130-7143; 7146-7159; 7162-7175; 9562-9575; 9674-9687; 9786-9799; 9898-9911; 10010-10023; 10122-10135; 10234-10247; 10346-10359; 8130-8143; 8146-8159; 8162-8175; 8178-8191; 8194-8207; 8210-8223; 8226-8239; 8242-8255; 8258-8271; 8274-8287; 8290-8302; 8306-8319; 8322-8335; 9578-9591; 9690-9703; 9802-9815; 9914-9927; 10026-10039; 10138-10151; 10250-10263; 10362-10375; 9290-9303; 9306-9319; 9322-9335; 9338-9351; 9354-9367; 9370-9383; 9386-9399; 9402-9415; 9418-9431; 9434-9447; 9450-9463; 9466-9479; 9482-9495; 9594-9607; 9706-9719; 9818-9831; 9930-9943; 10042-10055; 10154-10167; 10266-10279; 10378-10391; or a nucleic acid sequence having, in increasing order of preference, at least 50%, 60%, 70%, 80%, 90%, 95%, 96%, 97%, 98%, or 99% sequence identity to the any one of said nucleic acid sequences.

13. The artificial nucleic acid molecule according to any one of items 1 to 12, wherein said artificial nucleic acid molecule comprises a nucleic acid sequence according to any one of SEQ ID NOs: 10552; 3458-3459; 3460-3473; 2298-2299; 4618-4619; 5778-5779; 6938-6939; 8098-8099; 9258-9259; 2300-2313; 4620-4633; 5780-5793; 6940-6953; 8100-8113; 9260-9273; 3488-3489; 10396; 2328-2329; 10395; 4648-4649; 10397; 5808-5809; 10398; 6968-6969; 10399; 8128-8129; 10400; 9274-9287; 3504-3505; 3520-3521; 3536-3537; 3552-3553; 3568-3669; 3584-3585; 3600-3601; 3616-3617; 3632-3633; 3648-3649; 3664-3665; 3680-3681; 3696-3697; 9528-9529; 9640-9641; 9752-9753; 9864-9865; 9976-9977; 10088-10089; 10200-10201; 10312-10313; 10403; 10410; 10417; 10424; 10431; 10438; 10445; 10452; 10459; 10466; 10473; 10480; 10487; 10494; 10501; 10508; 10515; 10522; 10529; 10536; 10543; 2344-2345; 2360-2361; 2376-2377; 2392-2393; 2408-2409; 2424-2425; 2440-2441; 2456-2457; 2472-2473; 2489-2490; 2504-2505; 2520-2521; 2536-2537; 9512-9513; 9624-9625; 9736-9737; 9848-9849; 9960-9961; 10072-10073; 10184-10185; 10296-10297; 10402; 10409; 10416; 10423; 10430; 10437; 10444; 10451; 10458; 10465; 10472; 10479; 10486; 10493; 10500; 10507; 10514; 10521; 10528; 10535; 10542; 4664-4665; 4680-4681; 4696-4697; 4712-4713; 4728-4729; 4744-4745; 4760-4761; 4776-4777; 4792-4793; 4808-4809; 4824-4825; 4840-4841; 4856-4857; 9544-9545; 9656-9657; 9768-9769; 9880-9881; 9992-9993; 10104-10105; 10216-10217; 10328-10329; 10404; 10411; 10418; 10425; 10432; 10439; 10446; 10453; 10460; 10467; 10474; 10481; 10488; 10495; 10502; 10509; 10516; 10523; 10530; 10537; 10544; 5824-5825; 5840-5841; 5856-5857; 5872-5873; 5888-5889; 5904-5905; 5920-5921; 5936-5937; 5952-5953; 5968-5969; 5984-5985; 6000-6001; 6016-6017; 9560-9561; 9672-9673; 9784-9785; 9896-9897; 10008-10009; 10120-10121; 10232-10233; 10344-10345; 10405; 10412; 10419; 10426; 10433; 10440; 10447; 10454; 10461; 10468; 10475; 10482; 10489; 10496; 10503; 10510; 10517; 10524; 10531; 10538; 10545; 7033; 7048-7049; 7064-7065; 7080-7081; 7096-7097; 7112-7113; 7128-7129; 7144-7145; 7160-7161; 7176-7177; 9576-9577; 9688-9689; 9800-9801; 9912-9913; 10024-10025; 10136-10137; 10248-10249; 10360-10361; 10406; 10413; 10420; 10427; 10434; 10441; 10448; 10455; 10462; 10469; 10476; 10483; 10490; 10497; 10504; 10511; 10518; 10525; 10532; 10539; 10546; 8144-8145; 8160-8160; 8176-8177; 8192-8193; 8208-8209; 8224-8225; 8240-8241; 8256-8257;

8272-8273; 8288-8289; 8304-8305; 8320-8321; 8336-8337; 9592-9593; 9704-9705; 9816-9817; 9928-9929; 10040-10041; 10152-10153; 10264-10265; 10376-10377; 10407; 10414; 10421; 10428; 10435; 10442; 10449; 10456; 10463; 10470; 10477; 10484; 10491; 10498; 10505; 10512; 10519; 10526; 10533; 10540; 10547; 9288-9289; 10401; 10553; 10582-10583 10579-10580; 10585-10586; 10588-10589; 10591-10592; 10594-10595; 10597-10598; 10554-10574; 10601; 10602; 10615; 10616; 10629; 10630; 10643; 10644; 10657; 10658; 10671; 10672; 10685; 10686; 10699; 10700; 10713; 10714; 10727; 10728; 10741; 10742; 10755; 10756; 10769; 10770; 10783; 10784; 10797; 10798; 10811; 10812; 10825; 10826; 10839; 10840; 10853; 10854; 10867; 10868; 10881; 10882; 10603; 10604; 10617; 10618; 10631; 10632; 10645; 10646; 10659; 10660; 10673; 10674; 10687; 10688; 10701; 10702; 10715; 10716; 10729; 10730; 10743; 10744; 10757; 10758; 10771; 10772; 10785; 10786; 10799; 10800; 10813; 10814; 10827; 10828; 10841; 10842; 10855; 10856; 10869; 10870; 10883; 10884; 10605; 10606; 10619; 10620; 10633; 10634; 10647; 10648; 10661; 10662; 10675; 10676; 10689; 10690; 10703; 10704; 10717; 10718; 10731; 10732; 10745; 10746; 10759; 10760; 10773; 10774; 10787; 10788; 10801; 10802; 10815; 10816; 10829; 10830; 10843; 10844; 10857; 10858; 10871; 10872; 10885; 10886; 10607; 10608; 10621; 10622; 10635; 10636; 10649; 10650; 10663; 10664; 10677; 10678; 10691; 10692; 10705; 10706; 10719; 10720; 10733; 10734; 10747; 10748; 10761; 10762; 10775; 10776; 10789; 10790; 10803; 10804; 10817; 10818; 10831; 10832; 10845; 10846; 10859; 10860; 10873; 10874; 10887; 10888; 10609; 10610; 10623; 10624; 10637; 10638; 10651; 10652; 10665; 10666; 10679; 10680; 10693; 10694; 10707; 10708; 10721; 10722; 10735; 10736; 10749; 10750; 10763; 10764; 10777; 10778; 10791; 10792; 10805; 10806; 10819; 10820; 10833; 10834; 10847; 10848; 10861; 10862; 10875; 10876; 10889; 10890; 10611; 10612; 10625; 10626; 10639; 10640; 10653; 10654; 10667; 10668; 10681; 10682; 10695; 10696; 10709; 10710; 10723; 10724; 10737; 10738; 10751; 10752; 10765; 10766; 10779; 10780; 10793; 10794; 10807; 10808; 10821; 10822; 10835; 10836; 10849; 10850; 10863; 10864; 10877; 10878; 10891; 10892; 9304-9305; 9320-9321; 9336-9337; 9352-9353; 9368-9369; 9384-9385; 9400-9401; 9416-9417; 9432-9433; 9448-9449; 9464-9465; 9480-9481; 9496-9497; 9608-9609; 9720-9721; 9832-9833; 9944-9945; 10056-10057; 10168-10169; 10280-10281; 10392-10393; 10408; 10415; 10422; 10429; 10436; 10443; 10450; 10457; 10464; 10471; 10478; 10485; 10492; 10499; 10506; 10513; 10520; 10527; 10534; 10541; 10548, or a nucleic acid sequence having, in increasing order of preference, at least 50%, 60%, 70%, 80%, 90%, 95%, 96%, 97%, 98%, or 99% sequence identity to the any one of said nucleic acid sequences.

14. The artificial nucleic acid molecule according to any one of items 1 to 13, wherein said artificial nucleic acid molecule comprises or consists of a nucleic acid sequence according to any one of SEQ ID NOs: 11011-11042; 11249-1128011131-11162; 11367-11398; 11485-11516; 11603-11634; 11721-11752; 11839-11870; 11044-11116; 11282-11354; 11164-11236; 11400-11472; 11518-11590; 11636-11708; 11754-11826; 11872-11944; 11011-11042; 11249-11280; 11044-11116; 11282-11354; 11131-11162; 11367-11398; 11485-11516; 11603-11634; 11721-11752; 11839-11870; 11164-11236; 11400-11472; 11518-11590; 11636-11708; 11754-11826; 11872-11944; 11120-11122; 11240; 11241; 11358; 11359; 11476; 11477; 11594; 11595; 11712; 11713; 11830; 11831; 11948; 11949; 11123-11130; 11360-11366; 11242-11248; 11478-11484; 11596-11602; 11714-11720; 11832-11838; 11950-11956, or a nucleic acid sequence having, in increasing order of preference, at least 50%, 60%, 70%, 80%, 90%, 95%, 96%, 97%, 98%, or 99% sequence identity to the any one of said nucleic acid sequences.

15. The artificial nucleic acid molecule according to any one of items 1 to 14, wherein said artificial nucleic acid molecule is an RNA.

16. The RNA according to item 15, wherein the RNA is mono-, bi-, or multicistronic.

17. The RNA according to item 14 or 15, wherein the RNA is an mRNA, a viral RNA or a replicon RNA.

18. The artificial nucleic acid, preferably RNA, according to any one of items 1 to 17, wherein said artificial nucleic acid is a modified nucleic acid, preferably a stabilized nucleic acid.

19. The artificial nucleic acid, preferably RNA, according to any one of items 1 to 18, wherein
the G/C content of the at least one coding region of the artificial nucleic acid is increased compared to the G/C content of the corresponding coding sequence of the corresponding wild-type artificial nucleic acid, and/or wherein
the C content of the at least one coding region of the artificial nucleic acid is increased compared to the C content of the corresponding coding sequence of the corresponding wild-type artificial nucleic acid, and/or wherein
the codons in the at least one coding region of the artificial nucleic acid are adapted to human codon usage, wherein the codon adaptation index (CAI) is preferably increased or maximised in the at least one coding sequence of the artificial nucleic acid,
wherein the amino acid sequence encoded by the artificial nucleic acid is preferably not being modified compared to the amino acid sequence encoded by the corresponding wild-type artificial nucleic acid.

20. The artificial nucleic acid, preferably RNA, according to any one of items 1 to 19, which comprises a 5'-CAP structure, preferably m7GpppN or Cap1.

21. The artificial nucleic acid, preferably RNA, according to any one of 1 to 20, which comprises at least one histone stem-loop.

22. The artificial nucleic acid, preferably RNA, according to item 21, wherein the at least one histone stem-loop comprises a nucleic acid sequence according to the following formulae (I) or (II):

formula (I)
(stem-loop sequence without stem bordering elements):

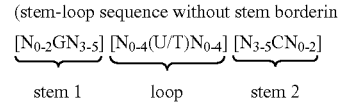

formula (II)
(stem-loop sequence with stem bordering elements):

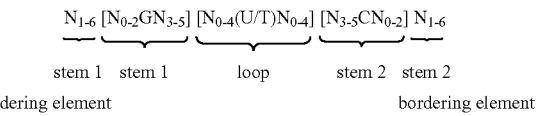

wherein:

| | |
|---|---|
| stem1 or stem2 bordering elements $N_{1-6}$ | is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof; |
| stem1 $[N_{0-2}GN_{3-5}]$ | is reverse complementary or partially reverse complementary with element stem2, and is a consecutive sequence between of 5 to 7 nucleotides; wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof; wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof; and wherein G is guanosine or an analogue thereof, and may be optionally replaced by a cytidine or an analogue thereof, provided that its complementary nucleotide cytidine in stem2 is replaced by guanosine; |
| loop sequence $[N_{0-4}(U/T)N_{0-4}]$ | is located between elements stem1 and stem2, and is a consecutive sequence of 3 to 5 nucleotides, more preferably of 4 nucleotides; wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally thymidine; |
| stem2 $[N_{3-5}CN_{0-2}]$ | is reverse complementary or partially reverse complementary with element stem1, and is a consecutive sequence between of 5 to 7 nucleotides; wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof; wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof; and wherein C is cytidine or an analogue thereof, and may be optionally replaced by a guanosine or an analogue thereof provided that its complementary nucleotide guanosine in stem1 is replaced by cytidine; | wherein stem1 and stem2 are capable of base pairing with each other forming a reverse complementary sequence, wherein base pairing may occur between stem1 and stem2, or forming a partially reverse complementary sequence, wherein an incomplete base pairing may occur between stem1 and stem2.

24. The artificial nucleic acid, preferably RNA, according to item 19 or 20, wherein the at least one histone stem-loop comprises a nucleic acid sequence according to the following formulae (Ia) or (IIa):

formula (Ia)
(stem-loop sequence without stem bordering elements):

$\underbrace{[N_{0-1}GN_{3-5}]}_{\text{stem 1}}$ $\underbrace{[N_{1-3}(U/T)N_{0-2}]}_{\text{loop}}$ $\underbrace{[N_{3-5}CN_{0-1}]}_{\text{stem 2}}$ formula (IIa)
(stem-loop sequence with stem bordering elements):

$\underbrace{N_{2-5}}_{\substack{\text{stem 1} \\ \text{bordering element}}}$ $\underbrace{[N_{0-1}GN_{3-5}]}_{\text{stem 1}}$ $\underbrace{[N_{1-3}(U/T)N_{0-2}]}_{\text{loop}}$ $\underbrace{[N_{3-5}CN_{0-1}]}_{\text{stem 2}}$ $\underbrace{N_{2-5}}_{\substack{\text{stem 2} \\ \text{bordering element}}}$ 25. The artificial nucleic acid, preferably RNA, according to any one of items 1 to 24, optionally comprising a poly(A) sequence, preferably comprising 10 to 200, 10 to 100, 40 to 80 or 50 to 70 adenosine nucleotides.

26. The artificial nucleic acid, preferably RNA, according to any one of items 1 to 25, optionally comprising a poly(C) sequence, preferably comprising 10 to 200, 10 to 100, 20 to 70, 20 to 60 or 10 to 40 cytosine nucleotides.

27. The artificial nucleic acid, preferably RNA, according to any one of items 1 to 26, which comprises, preferably in 5' to 3' direction, the following elements:
   a) a 5'-CAP structure, preferably m7GpppN or Cap1
   b) a 5'-UTR element, which comprises or consists of a nucleic acid sequence, which is derived from a 5'-UTR as defined in any one of items 1 to 5, preferably comprising an nucleic acid sequence corresponding to the nucleic acid sequence according to SEQ ID NO: 1; 3; 5; 7; 9; 11; 13; 15; 17; 19; or 21 or a homolog, fragment or variant thereof, c) at least one coding sequence as defined in any one of items 7 to 13 d) a 3'-UTR element, which comprises or consists of a nucleic acid sequence, which is derived from a 3'-UTR as defined in any one of items 1 to 5, preferably comprising a nucleic acid sequence corresponding to the nucleic acid sequence according to SEQ ID NO: 15; 17; 19; 21 29; 31; 33 or 35, or a homolog, a fragment or a variant thereof, e) optionally a poly(A) tail, preferably consisting of 10 to 1000, 10 to 500, 10 to 300, 10 to 200, 10 to 100, 40 to 80 or 50 to 70 adenosine nucleotides, f) optionally a poly(C) tail, preferably consisting of 10 to 200, 10 to 100, 20 to 70, 20 to 60 or 10 to 40 cytosine nucleotides, and g) optionally a histone stem-loop (HSL).

28. Composition comprising the artificial nucleic acid molecule, preferably an RNA, according to any one of items 1 to 26 and a pharmaceutically acceptable carrier and/or excipient.

29. The composition according to item 28, wherein the artificial nucleic acid molecule, preferably RNA, is complexed with one or more cationic or polycationic compounds, preferably with cationic or polycationic polymers, cationic or polycationic peptides or proteins, e.g. protamine, cationic or polycationic polysaccharides and/or cationic or polycationic lipids.

30. The composition according to item 29, wherein the N/P ratio of the artificial nucleic acid molecule, preferably RNA, to the one or more cationic or polycationic peptides or proteins is in the range of about 0.1 to 10, including a range of about 0.3 to 4, of about 0.5 to 2, of about 0.7 to 2 and of about 0.7 to 1.5.

31. The composition according to any one of items 28 to 30, wherein the artificial nucleic acid molecule, preferably RNA, is complexed with one or more lipids, thereby forming liposomes, lipid nanoparticles and/or lipoplexes.

32. The composition according to any one of items 28 to 31, further comprising at least one guide RNA (gRNA) or a nucleic acid encoding the same, said gRNA being capable of targeting the CRISPR-associated protein to a target DNA sequence of interest, or a regulatory element operably linked thereto.

33. Kit, preferably kit of parts, comprising the artificial nucleic acid molecule, preferably RNA, according to any one of items 1 to 27 or the composition according to any one of items 28 to 32, and optionally a liquid vehicle and/or optionally technical instructions with information on the administration and dosage of the artificial nucleic acid molecule or the composition.

34. The kit according to item 33, wherein the kit contains as a part Ringer-Lactate solution.

35. The kit according to item 33 or 34, further comprising a guide RNA (gRNA) or a nucleic acid encoding the same, said gRNA being capable of targeting the CRISPR-associated protein to a target DNA sequence of interest, or a regulatory element operably linked thereto.

36. The artificial nucleic acid molecule, preferably RNA, according to any one of items 1 to 27, the composition according to any one of items 28 to 32, or the kit according to item 33 to 35 for use as a medicament.

37. The artificial nucleic acid molecule, preferably RNA, according to any one of items 1 to 27, the composition according to any one of items 28 to 32, or the kit according to item 33 to 35 for use in gene therapy.

38. The artificial nucleic acid molecule, preferably RNA, according to any one of items 1 to 27, the composition according to any one of items 28 to 32, or the kit according to item 33 to 35 for use in a method of modulating the expression of a gene of interest, comprising administering to a patient in need thereof (a) said artificial nucleic acid molecule, preferably RNA, said composition or said kit and (b) a guide RNA (gRNA) or a nucleic acid encoding the same, said sgRNA being capable of targeting the CRISPR-associated protein to a gene of interest, or a regulatory element operably linked thereto.

39. The artificial nucleic acid molecule, preferably RNA, according to any one of items 1 to 27, the composition according to any one of items 28 to 32, or the kit according to item 33 to 35 for use as a medicament or for use in gene therapy in a disease, disorder or condition amenable to treatment by expression of CRISPR-associated protein encoded by the at least one coding sequence.

40. The artificial nucleic acid molecule, preferably RNA, according to any one of items 1 to 27, the composition according to any one of items 28 to 32, or the kit according to item 33 to 35 for use as a medicament or for use in gene therapy in a disease, disorder or condition amenable by knocking in, knocking out or manipulating a gene of interest, or by modulating the expression of a gene of interest.

41. The artificial nucleic acid molecule, preferably RNA, composition or kit for the use according to item 40, wherein said disease, disorder or condition is selected from genetic diseases, cancer, autoimmune diseases, inflammatory diseases, and infectious diseases.

42. Use of the artificial nucleic acid molecule, preferably RNA, according to any one of items 1 to 27, the composition according to any one of items 28 to 32, or the kit according to item 33 to 35 for increasing the expression of said encoded CRISPR-associated protein, optionally in gene therapy.

43. Use of the artificial nucleic acid molecule, preferably RNA, according to any one of items 1 to 27, the composition according to any one of items 28 to 32, or the kit according to item 33 to 35 for modulating the expression of a gene of interest targeted by said encoded CRISPR-associated protein.

44. A method for modulating the expression of a gene of interest comprising the steps of:
  a) providing an artificial nucleic acid molecule, preferably RNA, according to any one of items 1 to 27;
  b) providing a guide RNA (gRNA) or a nucleic acid encoding the same, said gRNA being capable of targeting the CRISPR-associated protein to a target DNA sequence of interest, or a regulatory element operably linked thereto,
  c) contacting a cell, tissue or organism with said artificial nucleic acid molecule, preferably RNA, and said gRNA or nucleic acid encoding the same under conditions suitable to modulate expression efficacy of said gene of interest.

45. A method of treating or preventing a disorder, wherein the method comprises administering to a subject in need thereof an effective amount of the artificial nucleic acid molecule, preferably RNA, according to any one of items 1 to 27, the composition according to any one of items 28 to 32, or the kit according to item 33 to 35, and a guide RNA (gRNA) or a nucleic acid encoding the same, said gRNA being capable of targeting the CRISPR-associated protein to a target DNA sequence of interest, or a regulatory element operably linked thereto.

46. The method according to item 45, wherein the disorder is a disease, disorder or condition amenable to treatment by expression of the encoded CRISPR-associated protein, preferably amenable to treatment by modulating the expression of a gene of interest targeted by said CRISPR-associated protein.

47. The method according to item 45 or 46, wherein the disorder is a disease, disorder or condition is amenable by knocking in, knocking out or by mutating a gene of interest, or by altering the expression of a gene of interest.

48. A method for increasing the expression efficacy of an artificial nucleic acid molecule, preferably RNA, comprising a coding region encoding a CRISPR-associated protein, said method comprising
    (a) associating said coding region with a at least one 5' UTR element derived from a 5' UTR of a gene selected from the group consisting of ATP5A1, RPL32, HSD17B4, SLC7A3, NOSIP, or NDUFA4, or from a corresponding RNA sequence, homolog, a fragment or a variant thereof;
    (b) associating said coding region with at least one 3' UTR element derived from a 3' UTR of a gene selected from the group consisting of GNAS, CASP1, PSMB3, ALB, or RPS9, or from a corresponding RNA sequence, homolog, a fragment or a variant thereof; and
    (c) obtaining an artificial nucleic acid molecule, preferably RNA, according to any one of items 1 to 47.

EXAMPLES

Figure 1:
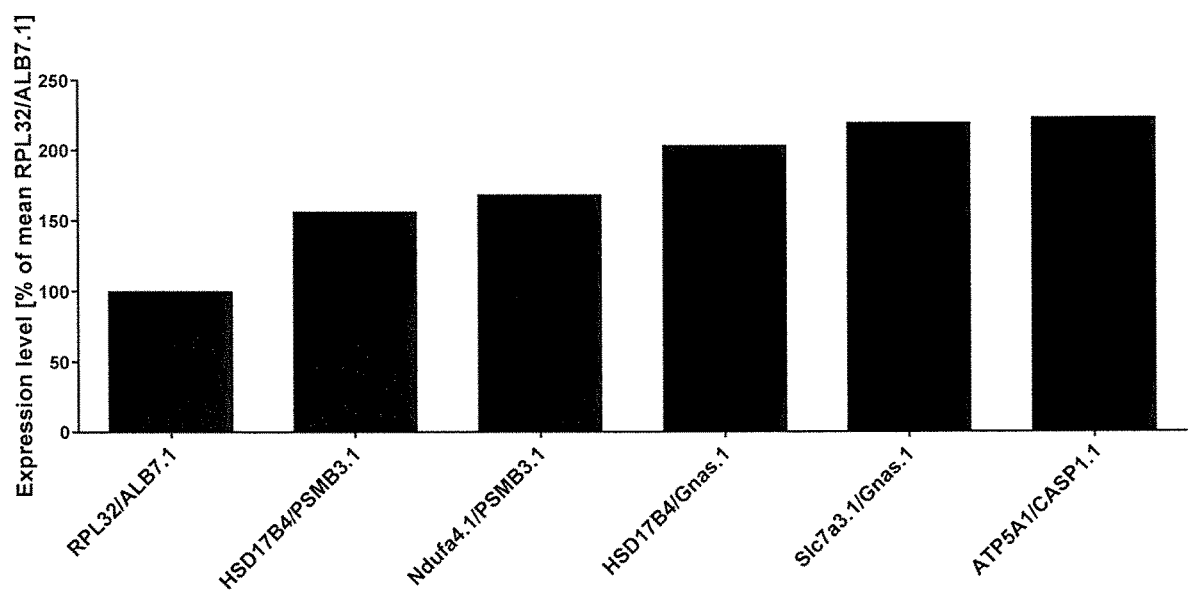
FIG. 1 shows the effect of different UTR combinations on the expression level of Cas9 in HeLa cells as detailed in Example 1 (In-Cell Western). The y-axis is normalized to show an expression level of 100% for the UTR combination RPL32/ALB7.1.

In the following, particular examples illustrating various embodiments and aspects of the invention are presented. However, the present invention shall not to be limited in scope by the specific embodiments described herein. The following preparations and examples are given to enable those skilled in the art to more clearly understand and to practice the present invention. The present invention, however, is not limited in scope by the exemplified embodiments, which are intended as illustrations of single aspects of the invention only, and methods which are functionally equivalent are within the scope of the invention. Indeed, various modifications of the invention in addition to those described herein will become readily apparent to those skilled in the art from the foregoing description, accompanying figures and the examples below. All such modifications fall within the scope of the appended claims.

Example 1: Detection of Cas9 Expression in HeLa, Hek293T and HepG2 Cells Using In-Cell-Western and Western Blot Analysis Cells were seeded in 96-well plates (Nunc Microplate Black w/Clear Optical Bottom; Thermo Fisher) with a density of 10,000 cells/well for Hela; 20,000 cells/well for Hek293T and HEPG2) in a compatible complete cell medium (200 µl). Cells were maintained at 37° C., 5% CO2 for 24 hours. The day of transfection, the complete medium was replaced with 50 µl of serum-free Opti-MEM medium (Thermo Fisher). 100 ng of each mRNA, i.e. SEQ ID NO: 14274 (RPL32/ALB7.1), SEQ ID NO: 14275 (HSD17B4/CASP1.1), SEQ ID NO: 14276 (SLC7A3.1/PSMB3.1), SEQ ID NO: 14277 (SLC7A3.1/CASP1.1), SEQ ID NO: 14278 (NOSIP.1/PSMB3.1), SEQ ID NO: 14279 (NDUFA4.1/RPS9.1), SEQ ID NO: 14280 (NDUFA4.1/PSMB3.1), SEQ ID NO: 14281 (HSD17B4/PSMB3.1) and SEQ ID NO: 14282 (HSD17B4/RPS9.1) were lipocomplexed using Lipofectamine 3000 in 50 µl of Opti-MEM with a ratio mRNA:Lipofectamine 3000 of 1:1.5. Lipocomplexed mRNAs were then added to corresponding 96-well-plates. Three hours after transfection, the complete medium was replaced with 100 µl of complete cell medium. Cells were further maintained for 24 hours at 37° C., 5% CO2 before performing In-cell-Western.

For In-Cell Western analysis (HeLa and Hek293T), the cells were washed twice with PBS1×, and fixed with a solution of methanol/acetone (1:1) for 10 minutes. After the fixation, the cells were subsequently washed three times with PBS1× for 5 minutes each. To avoid non-specific bindings, the cells were blocked for 1 hour at room temperature with Odyssey blocking buffer (PBS, LI-COR) supplemented with 0.01% Triton X100, and then incubated for one hour and half with primary antibodies, i.e. polyclonal rabbit antibodies against spCas9 (1/1000; #632606; Clontech/Takara). The cells were then washed 4 times with 0.1% Tween-20 in PBS1× for 5 minutes under mild shaking (80 rpm).

Subsequently, secondary antibodies, i.e. infrared Dye® 800CW goat anti-rabbit polyclonal antibodies (1/250; LI-COR), were mixed with Cell-Tag 700 Stain (1/5000; LI-COR) in Odyssey blocking buffer and incubated in the dark one hour at room temperature. A washing step was performed as described above before scanning using Odyssey® CLx Imaging system (LI-COR). Relative quantification (800/700) was obtained using Image Studio™ Lite Software. Background fluorescence obtained from wells lipofected without mRNA was subtracted to the measurement and the results compared to expression from a commercially available Cas9-encoding RNA (TriLink BioTechnologies, LLC, Cat. No. L-6125).

For HepG2 cells, the analysis was performed using Western blot. Plates were washed twice in PBS1×, and incubated directly with 50 µl sample loading buffer 1× (Biorad) containing Benzonase Endonuclease (Millipore) for 20 minutes at room temperature. The plates were then incubated at 95° C. for 5 minutes and centrifuged.

15 µl of lysates were run on 10% Mini-Protean TGX gels (Biorad) and transferred to nitrocellulose membranes (100V; 90 minutes). The membranes were washed three times with 0.1 Triton X100 in PBS for ten minutes each and saturated with 10% milk in PBS1× overnight at 4° C.

Polyclonal rabbit antibodies against spCas9 (1/1000; #632606; Clontech/Takara) and a control mouse monoclonal Anti-beta Actin antibody (1/10000; ab6276; Abcam) in 5% milk in PBS1× were incubated for one hour at room temperature. Membranes were subsequently washed three times in 0.1% Tween-20 in TBS1×. Infrared Dye® 800CW goat anti-rabbit polyclonal and infrared Dye® goat anti-mouse antibodies (1/7500 and 1/10000 respectively were used for detection). The wash step as described below was repeated three times before scanning using Odyssey® CLx Imaging system (LI-COR). Band intensity and relative quantification was performed using Studio™ Lite Software (LI-COR).

Figure 3:
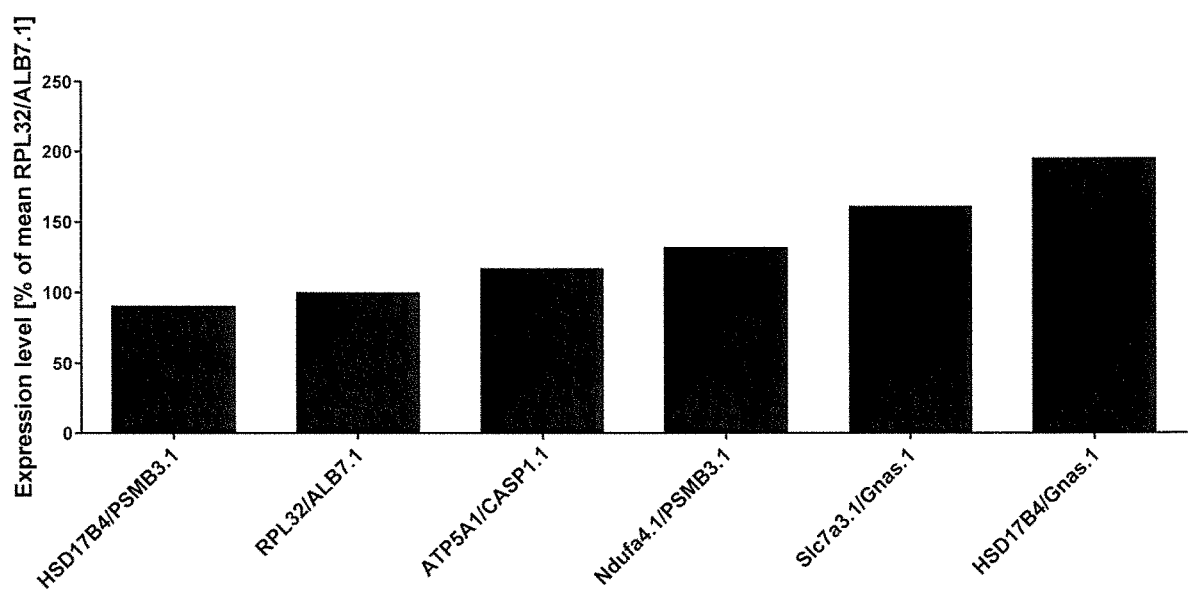
FIG. 3 shows the effect of different UTR combinations on the expression level of Cas9 in HepG2 cells as detailed in Example 1 (Western blot). The y-axis is normalized to show an expression level of 100% for the UTR combination RPL32/ALB7.1.
Figure 6:
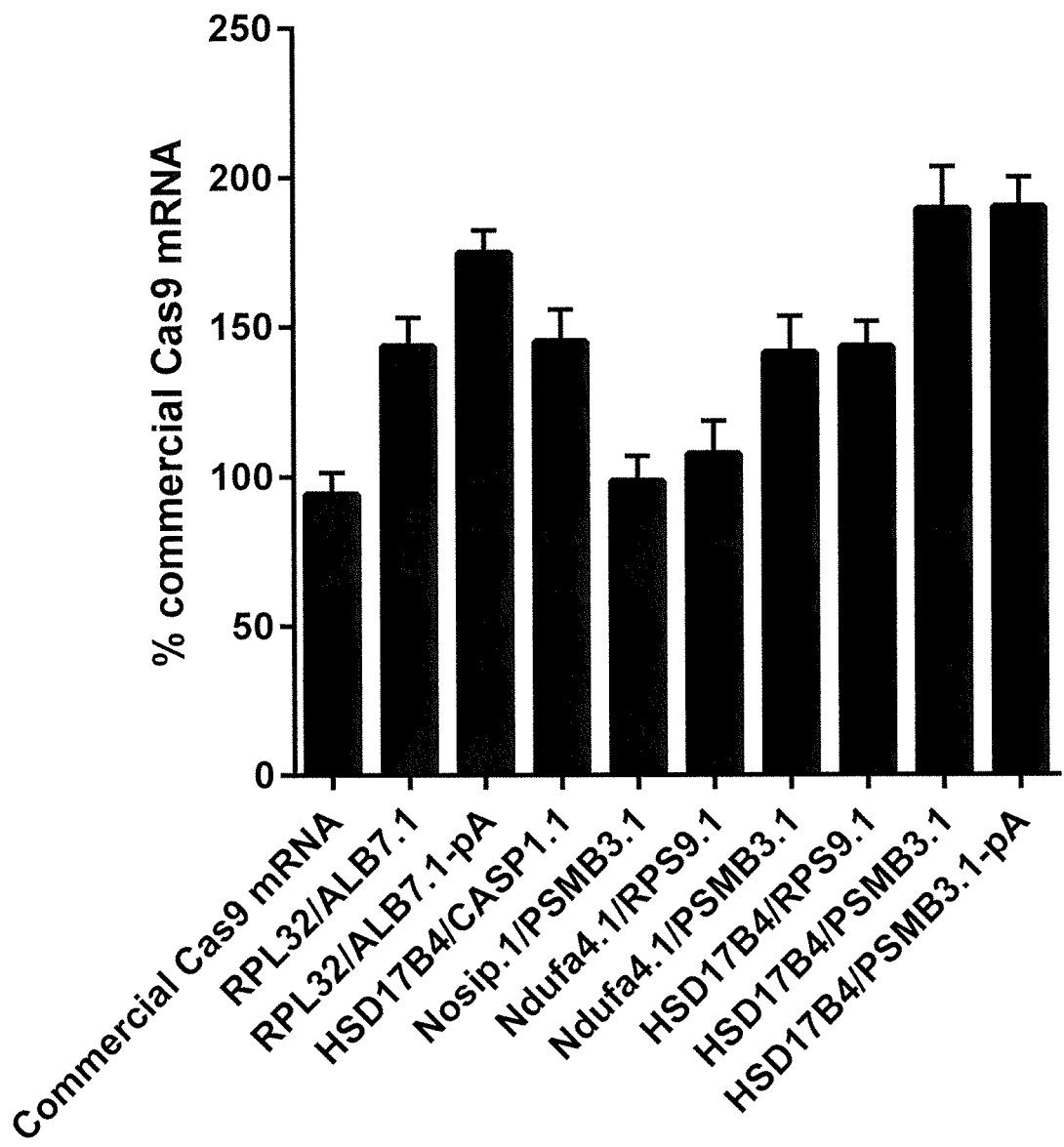
FIG. 6 shows the expression level of optimized spCas9 mRNA constructs in HeLa cells as detailed in Example 1 (In-cell Western) in comparison to a commercially available Cas9 mRNA. The y-axis is normalized to show an expression level of 100% for the commercial Cas9 mRNA.
Figure 7:
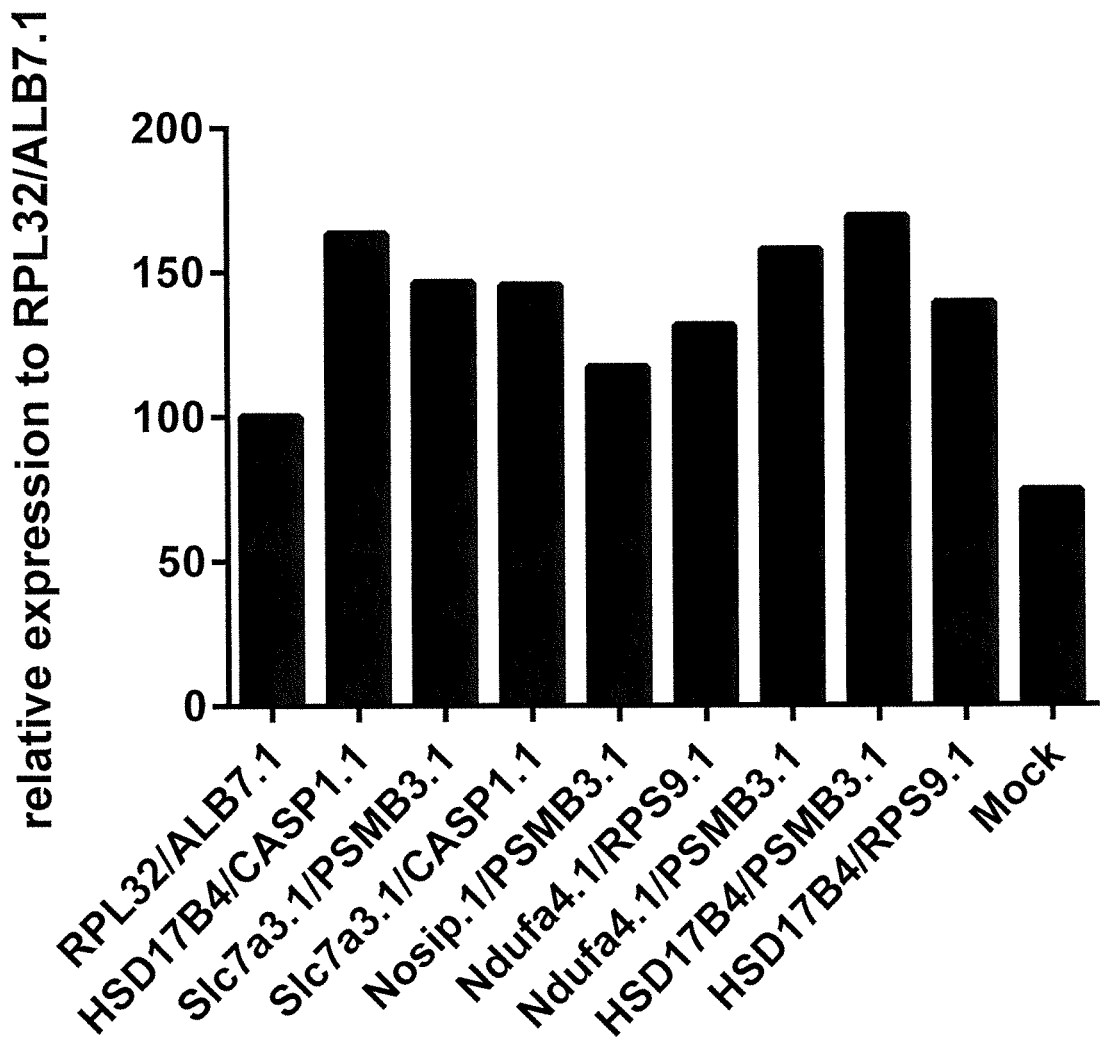
FIG. 7 shows the expression level of optimized spCas9 mRNA constructs in HeLa cells as detailed in Example 1 (In-cell Western). The y-axis is normalized to show an expression level of 100% for the UTR combination RPL32/ALB7.1

Cas9-encoding mRNAs comprising the UTR-combinations according to the invention exhibit increased expression (FIG. 1, FIG. 3, FIG. 7) that is highly superior as compared to commercially available Cas9 mRNA (FIG. 6).

Example 2: Detection of Cas9 Expression in HeLa Cells Using Western Blot Analysis Hela cells were seeded in 12-well plates (Nunc; Thermo Fisher) with a final density of 200,000 cells/well for Hela in complete cell medium (RPMI; 10% Fetal calf serum; 1% penicillin/streptomycin and 1% L-Glutamine; Lonza). Cells were maintained at 37° C., 5% CO2 for 24 hours. The day of transfection, the complete medium was replaced with 750 µl of serum-free Opti-MEM medium (Thermo Fisher). One µg of Cas9-encoding mRNA, i.e. SEQ ID NO: 14274 (RPL32/ALB7.1), SEQ ID NO: 14275 (HSD17B4/CASP1.1), SEQ ID NO: 14276 (SLC7A3.1/PSMB3.1), SEQ ID NO: 14277 (SLC7A3.1/CASP1.1), SEQ ID NO: 14278 (NOSIP.1/PSMB3.1), SEQ ID NO: 14279 (NDUFA4.1/RPS9.1), SEQ ID NO: 14280 (NDUFA4.1/PSMB3.1), SEQ ID NO: 14281 (HSD17B4/PSMB3.1) and SEQ ID NO: 14282 (HSD17B4/RPS9.1), comprising the inventive UTR combination (cf. Figure Legends) were lipocomplexed using Lipofectamine 3000 in 250 µl of Opti-MEM with a ratio mRNA:Lipofectamine 3000 of 1:1.5. Lipocomplexed mRNAs were then added to each well. Three hours after transfection, the complete medium was replaced with 1 ml of complete cell medium. Cells were further maintained for 24 hours at 37° C., 5% CO2 before performing protein extraction.

Wells were washed twice in PBS1×, and incubated directly with 100 µl sample loading buffer 1× (Biorad) containing Benzonase Endonuclease (Millipore) for 20 minutes at room temperature. The cells were scraped and the lysates transferred into Eppendorf tubes. The samples were then denaturated at 95° C. for 5 minutes, cooled in ice for five minutes and centrifuged at maximal speed for two minutes before loading.

15 µl of lysates were run on 10% Mini-Protean TGX gels (Biorad) and transferred to nitrocellulose membranes (100V; 90 minutes). The membranes were washed three times with 0.1 Triton X100 in PBS for ten minutes each and saturated with 10% milk in PBS1× overnight at 4° C.

Polyclonal rabbit antibodies against spCas9 (1/1000; #632606; Clontech/Takara) and a mouse monoclonal Anti-beta Actin antibody (1/10000; ab6276; Abcam) in 5% Milk in PBS1× were incubated for one hour at room temperature. Membranes were subsequently washed three times in 0.1% Tween-20 in TBS1×. Infrared Dye® 800CW goat anti-rabbit polyclonal and infrared Dye® goat anti-mouse antibodies (1/7500 and 1/10000 respectively were used for detection). The wash step as described below was repeated three times before scanning using Odyssey® CLx Imaging system (LI-COR). Band intensity and relative quantification was performed using Studio™ Lite Software (LI-COR).

Figure 2:
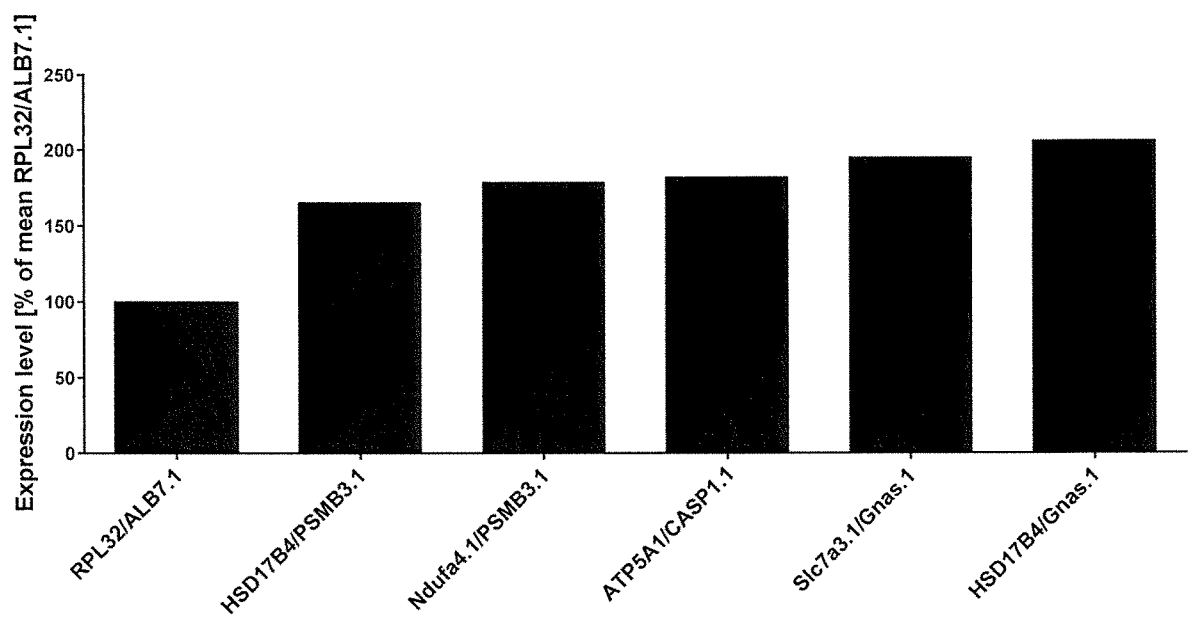
FIG. 2 shows the effect of different UTR combinations on the expression level of Cas9 in Hek293T cells as detailed in Example 2 (In-Cell Western). The y-axis is normalized to show an expression level of 100% for the UTR combination RPL32/ALB7.1.
Figure 4:
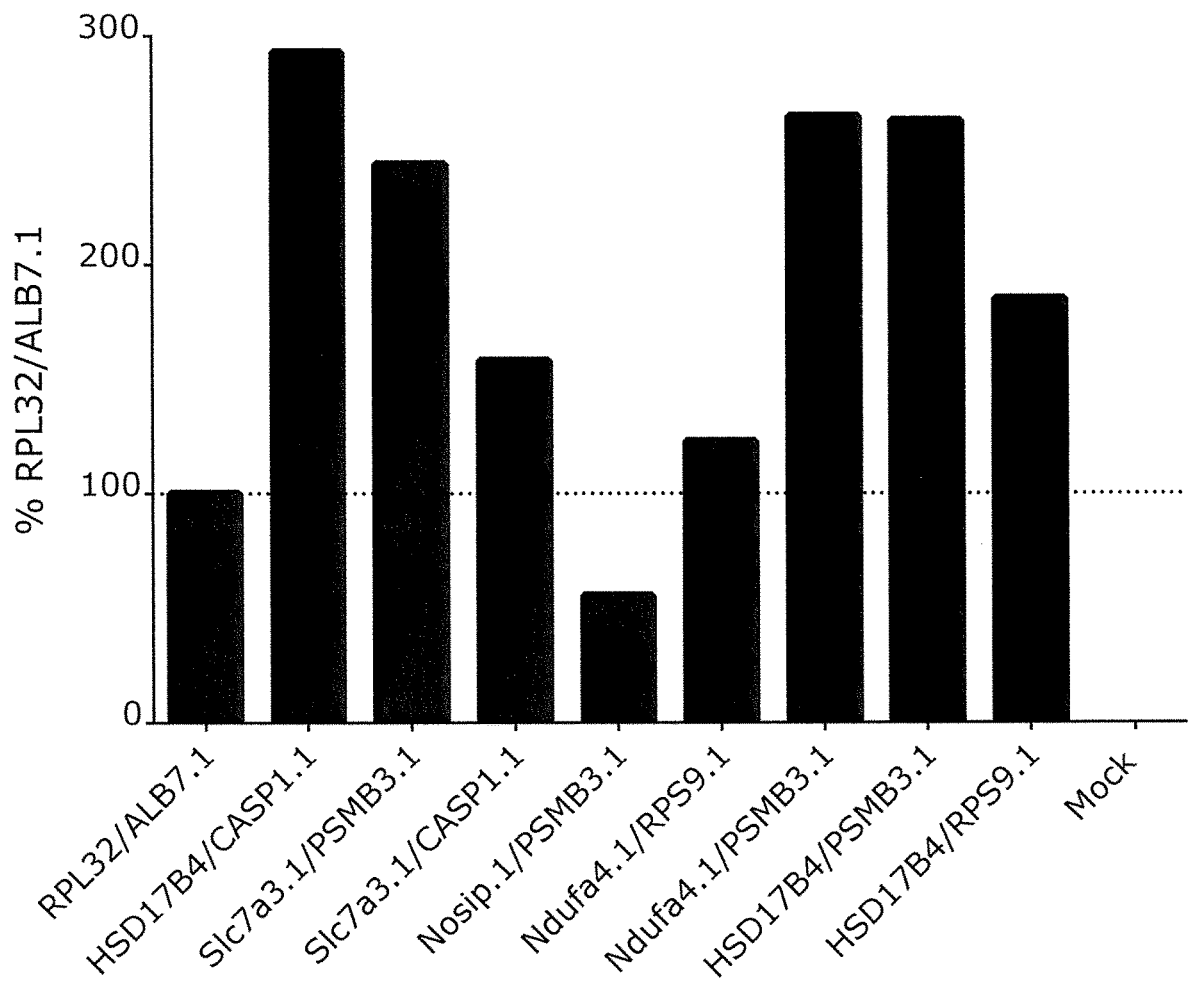
FIG. 4 shows the expression level of optimized spCas9 mRNA constructs in HeLa cells as detailed in Example 2 (Western blot). The y-axis is normalized to show an expression level of 100% for the UTR combination RPL32/ALB7.1.
Figure 5:
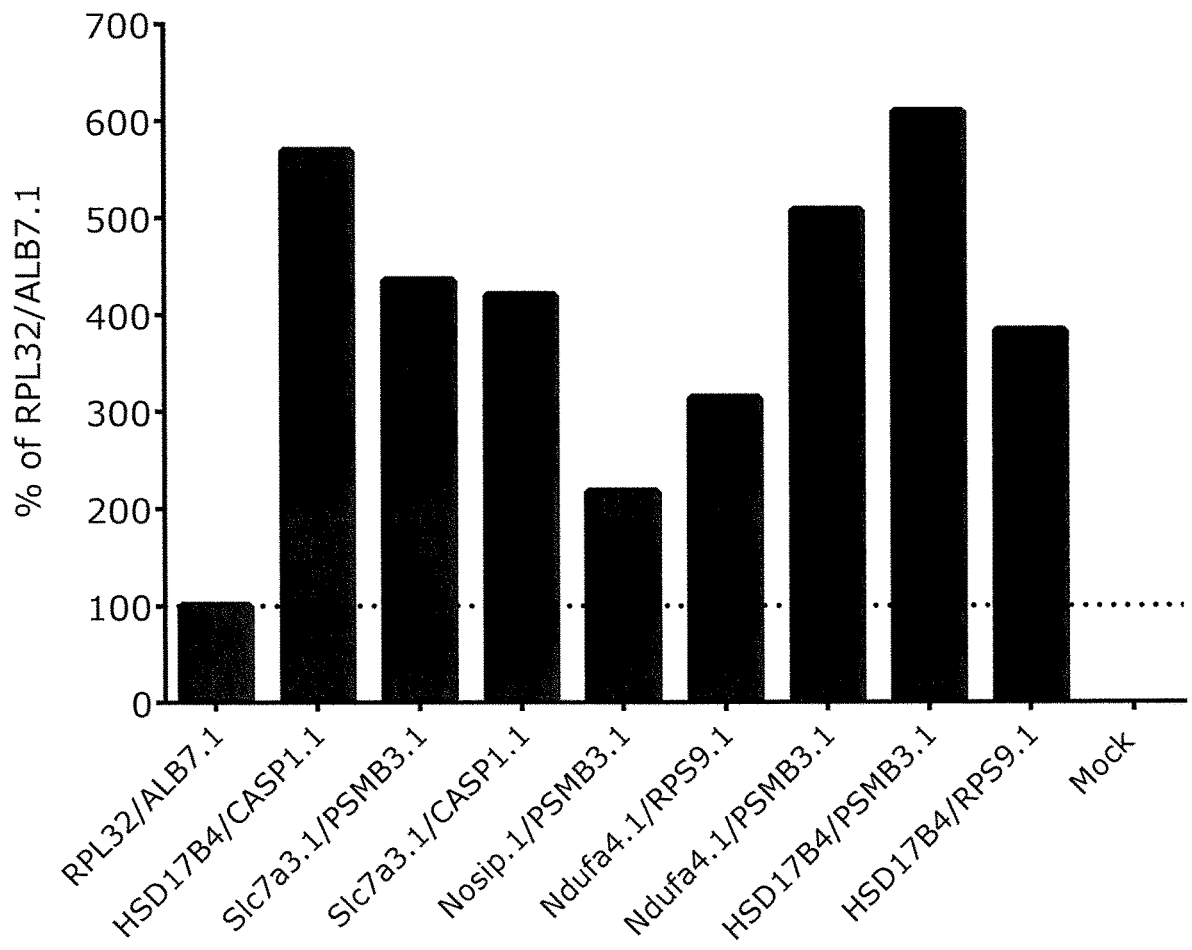
FIG. 5 shows the expression level of optimized spCas9 mRNA constructs in HeLa cells as detailed in Example 2 (In-cell Western). The y-axis is normalized to show an expression level of 100% for the UTR combination RPL32/ALB7.1.
Figure 8:
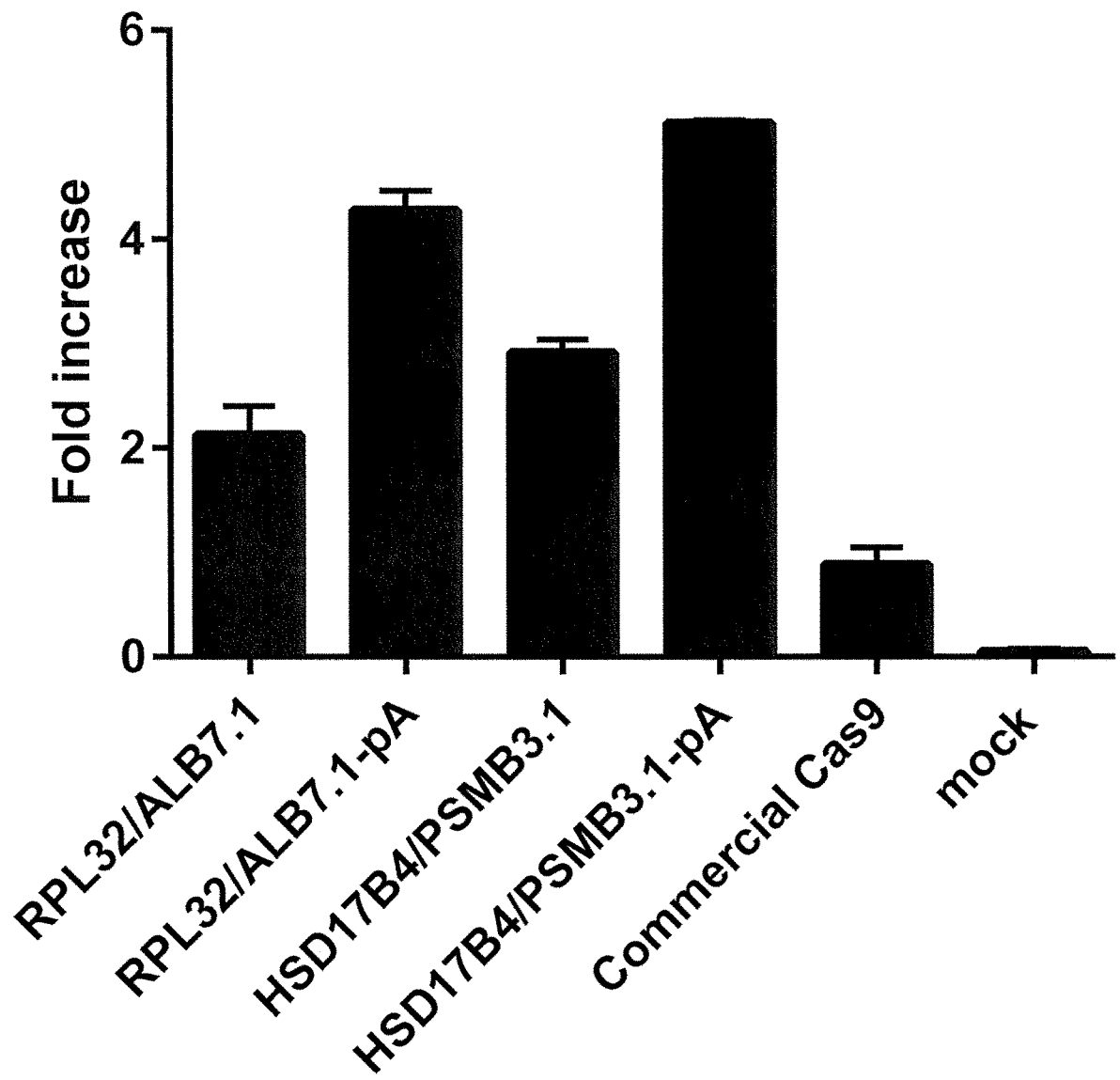
FIG. 8 shows the expression level of optimized spCas9 mRNA constructs in Hek293T cells as detailed in Example 2 (In-cell Western) in comparison to a commercially available Cas9 mRNA.
Figure 9:
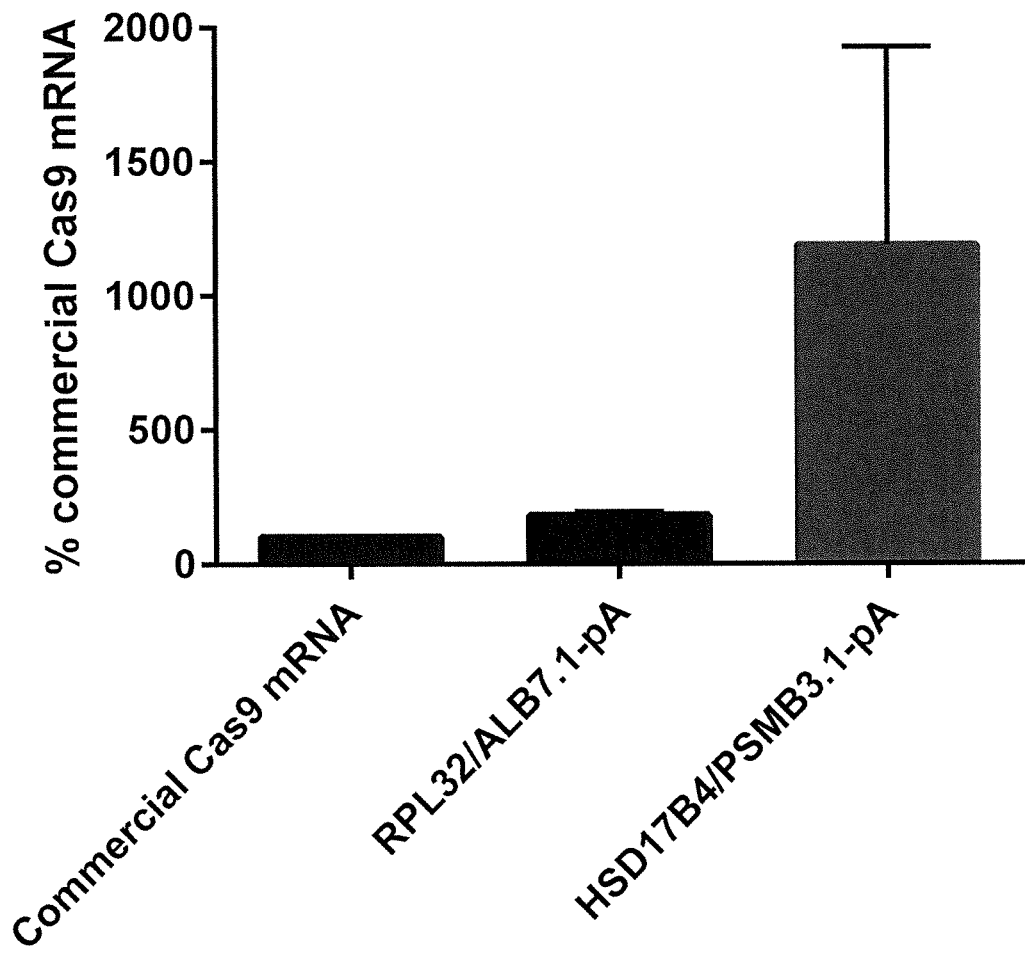
FIG. 9 shows the expression level of optimized spCas9 mRNA constructs in HepG2 cells as detailed in Example 2 (Western blot) in comparison to a commercially available Cas9 mRNA. The y-axis is normalized to show an expression level of 100% for the commercial Cas9 mRNA.

Cas9 expression from the inventive mRNAs was compared to expression from a commercially available Cas9-encoding RNA (TriLink BioTechnologies, LLC, Cat. No. L-6125). Cas9-encoding mRNAs comprising the UTR-combinations according to the invention exhibit increased expression (FIG. 2, FIG. 4, FIG. 5) that is highly superior as compared to commercially available Cas9 mRNA (FIG. 8, FIG. 9).

Example 3: Determination of In Vitro spCas 9 Activity Using Mismatch Detection Assay Cells were seeded in 96-well plates with a density of 50,000 cells/well for Hela in a complete cell medium (200 µl of RPMI; 10% fetal calf serum; 1% penicillin/streptomycin and 1% L-Glutamine; Lonza). Cells were maintained at 37° C., 5% CO2 for 24 hours. The day of transfection, hundred ng of spCas9 mRNA (SEQ ID NO: 14274=RPL32/ALB7.1, SEQ ID NO: 14281=HSD17B4/PSMB3.1—each mRNA one time w/o additional enzymatic polyadenylation and one time w/additional enzymatic polyadenylation; as reference commercially available Cas9-encoding RNA TriLink BioTechnologies, LLC, Cat. No. L-6125 was used) were lipocomplexed with a mixture of crRNA against human peptidylprolyl isomerase B (PPIB, i.e. Cyclophilin B; Dharmacon; SO-2544646G) (25 nM) and tracrRNA (25 nM; Dharmacon; U-002000-20) using TransIT® mRNA transfection (Mirus Bio). As negative controls spCas9 mRNA or guide RNAs or both were omitted in the transfection mixture. A final volume of 10 μl was added to the medium in the 96-well-plate. Three hours after transfection, the complete medium was replaced with 100 μl of complete cell medium. Cells were further maintained for 24 hours at 37° C., 5% CO2 before performing cell extraction.

Wells were washed one time with PBS1× and cells lysed at 56° C. for 30 minutes using 100 μl of Phusion HF buffer 1× containing 1 mg/ml Proteinase K and 0.5 mg/ml RNAse A (Thermo Fisher). A denaturation step at 95° C. for 5 minutes was added at the end of the lysis.

Five μl of cell lysates were used for PCR amplification of hPPIB fragment using specific primers against human PPIB (Edit-R PPIB crRNA Control Kit; UK-007060; Dharmacon) and Phusion hot-start II high fidelity DNA polymerase (Thermo Fisher). PCR conditions for amplification were the following:
1) denaturation step: 98° C. for 3 min.;
2) Touchdown PCR cyclic reaction 10× (denaturation 98° C. for 10 sec.; touchdown annealing 72° C.-1° C./cycle for 15 sec.; extension 72° C. for 30 sec.);
3) normal PCR cyclic reaction 25× (denaturation 98° C. for 10 sec.; annealing 62° C. for 15 sec.; extension 72° C. for 30 sec.);
4) final extension 72° C. for 10 minutes.

PCR samples were then heated at 95° C. for 10 minutes and slowly cooled at room temperature for more than 15 minutes.

Figure 10:
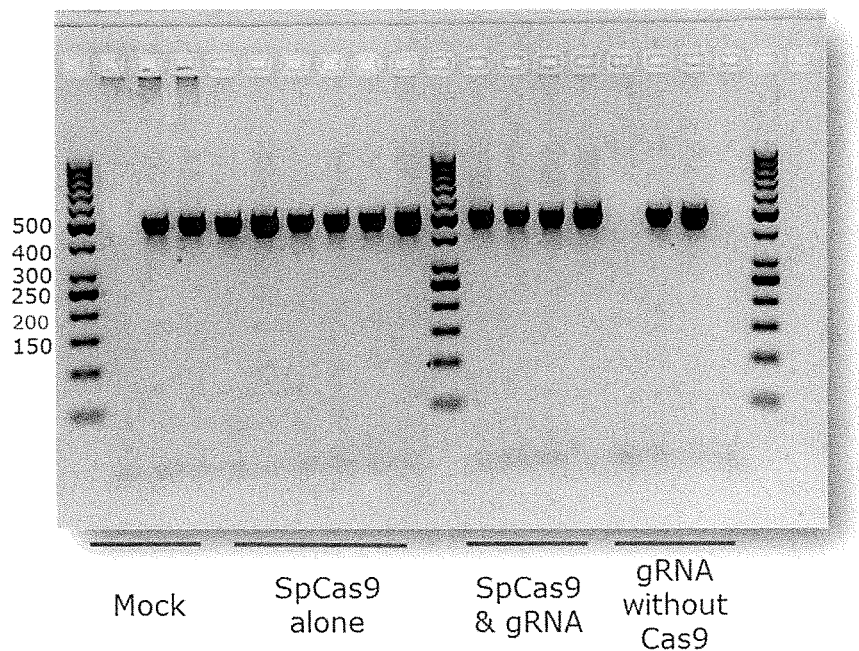
FIG. 10 shows DNA editing activity of spCas9 expressed from mRNA constructs as detailed in Example 3 by mismatch nuclease assay/mismatch detection assay). A: PCR amplification, B: mismatch detection assay.
Figure 10:
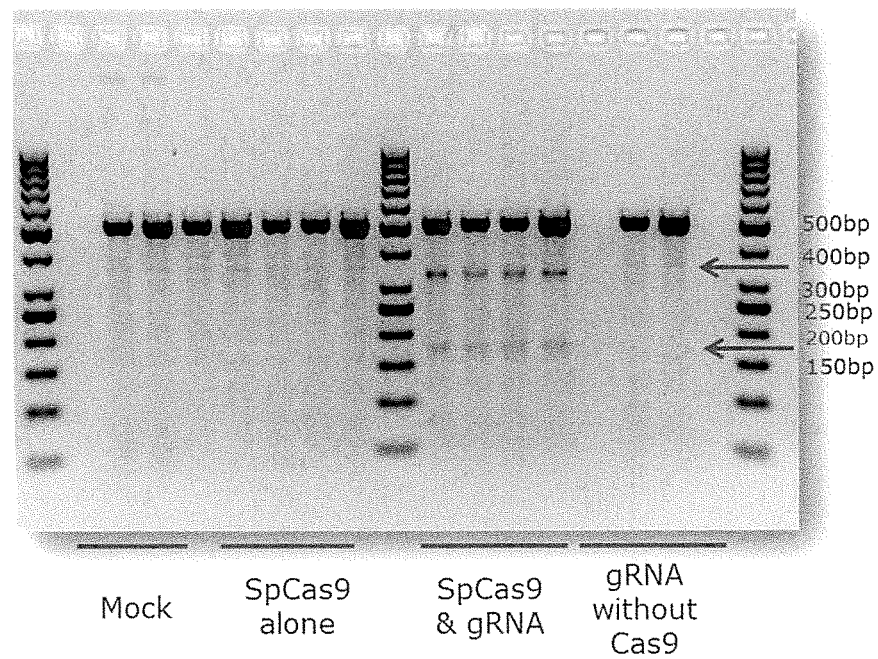

The mismatch detection assay was done using 10 μl of PCR reaction, NEB Buffer 2 and T7 endonuclease (New England BioLabs) during an incubation period of 25 min. at 37° C. Entire reaction volume was immediately run on 2% agarose gel. The expected band was 505 bp (no editing) or respectively 330 bp and 174 bp (with editing).

spCas9 expressed from the mRNAs comprising the inventive UTR combination was able to edit target DNA and thus functional (FIGS. 10A, B)

Example 4: Detection of Cpf1 Expression in HeLa, Hek293T and HepG2 Cells Using In-Cell-Western Cells were seeded in 96-well plates (Nunc Microplate Black w/Clear Optical Bottom; Thermo Fisher) with a density of 10,000 cells/well for Hela; 20,000 cells/well for HepG2 and Hek293T) in a compatible complete cell medium as used before (200 μl). Cells were maintained at 37° C., 5% CO2 for 24 hours. The day of transfection, 100 ng of mRNA i.e. SEQ ID NO: 10549 (RPL32/ALB7), SEQ ID NO: 14289 (Mp68/Gnas.1), SEQ ID NO: 14290 (Ndufa4.1/PSMB3.1), SEQ ID NO: 14291 (HSD17B4/Gnas.1), SEQ ID NO: 14292 (HSD17B4/PSMB3.1) and SEQ ID NO: 14293 (Ndufa4.1/Alb7) (for transfection of HeLa and Hek293T cells) and 500 ng of mRNA i.e. the identical SEQ ID NO (HepG2) were lipocomplexed using Lipofectamine Messenger Max in 50 μl of Opti-MEM with a ratio mRNA:Lipofectamine Messenger Max of 1:1.5. Lipocomplexed mRNAs were then added to corresponding 96-well-plates. Cells were further maintained for 24 hours at 37° C., 5% CO2 before performing In-cell-Western.

For In-Cell Western analysis (HeLa, HepG2, and Hek293T), the cells were washed trice with PBS1×, and fixed with paraformaldehyde 4% for 10 minutes. After the fixation, the cells were subsequently washed three times with PBS1× for 5 minutes each and permeabilized with 2% Triton X100 in PBS for 15 minutes. To avoid non-specific bindings, the cells were blocked for 1 hour at room temperature with Odyssey blocking buffer (PBS, LI-COR), and then incubated for one hour and half with primary antibodies, i.e. polyclonal rabbit antibodies against HA (1/1000; H6908; Sigma Aldrich). The cells were then washed 4 times with 0.1% Tween-20 in PBS1× for 5 minutes under mild shaking (80 rpm).

Subsequently, secondary antibodies, i.e. infrared Dye® 800CW goat anti-rabbit polyclonal antibodies (1/500; LI-COR), were mixed with Cell-Tag 700 Stain (1/5000; LI-COR) in Odyssey blocking buffer and incubated in the dark one hour at room temperature. A washing step was performed as described above before scanning using Odyssey® CLx Imaging system (LI-COR). Relative quantification (800/700) was obtained using Image Studio™ Lite Software. Background fluorescence obtained from wells lipofected without mRNA was subtracted to the measurement and the results compared to expression from our standard mRNA.

Figure 11:
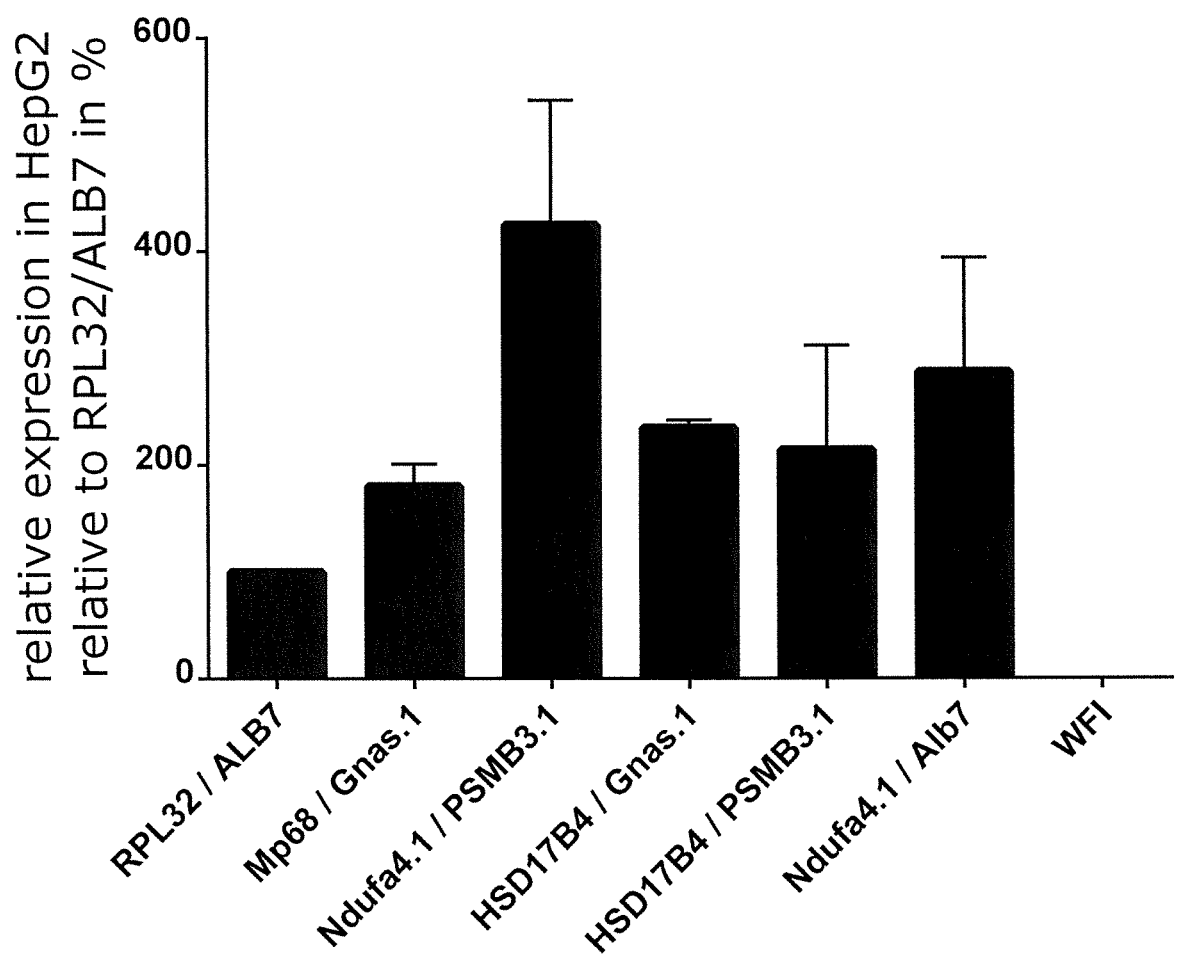
FIG. 11 shows the expression level of optimized Cpf1 mRNA constructs in HepG2 relative to RPL32/ALB7 in %. The y-axis is normalized to show an expression level of 100% for RPL32/ALB7 UTR combination Cpf1 mRNA.
Figure 12:
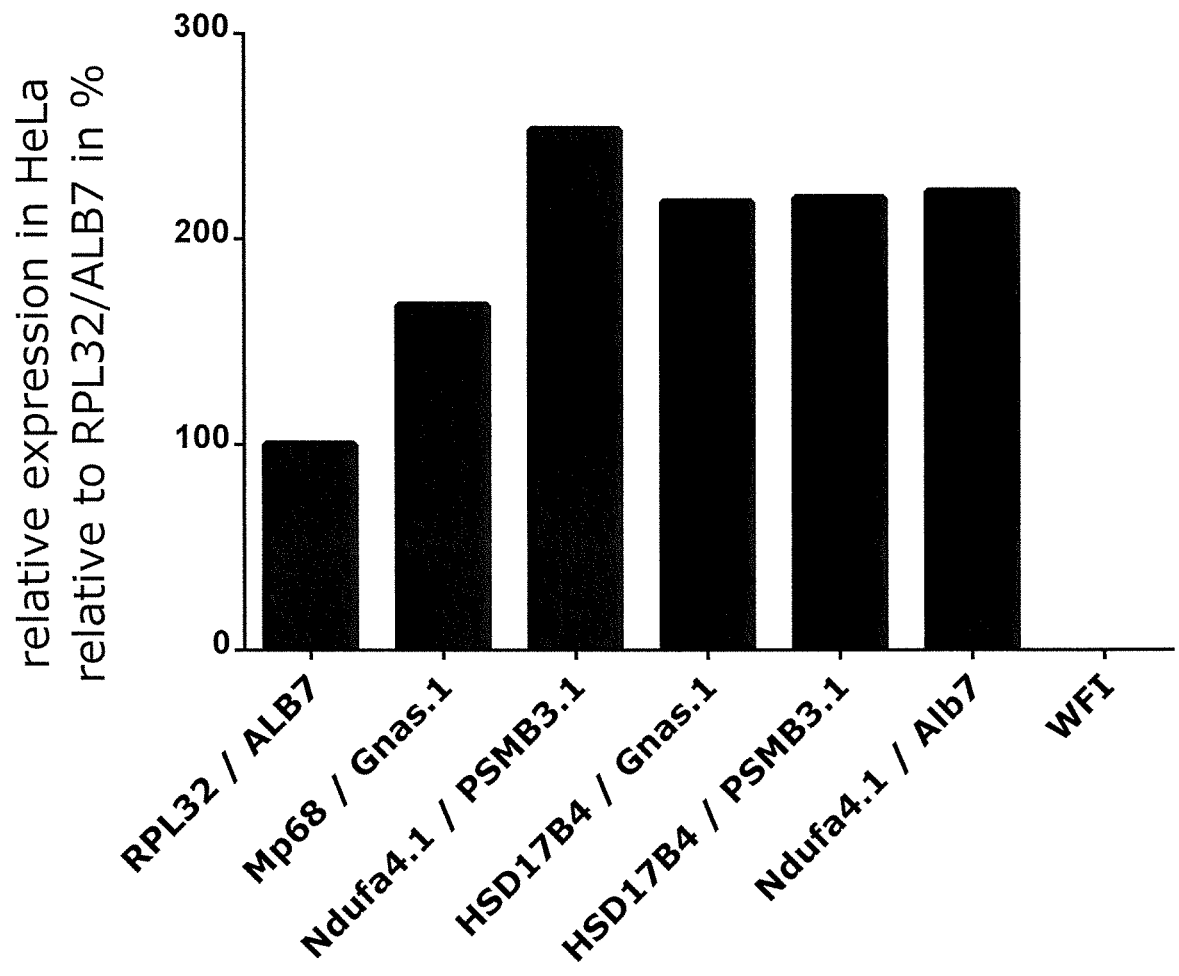
FIG. 12 shows the expression level of optimized Cpf1 mRNA constructs in HeLa relative to RPL32/ALB7 in %. The y-axis is normalized to show an expression level of 100% for RPL32/ALB7 UTR combination Cpf1 mRNA.

Cpf1-encoding mRNAs comprising the UTR-combinations according to the invention exhibit strongly increased expression that was highly superior as compared to a reference Cpf1 mRNA RPL32/Alb7. Expression is given relative to RPL32/ALB7 in % as apparent from FIG. 11 and FIG. 12 (HepG2 and HeLa cells).

SEQUENCE LISTING (14546 sequences)

SEQ ID NO: 1 - DNA, 62 bp, Artificial Sequence
  5'-UTR_HSD17B4
gtcccgcagtcggcgtccagcggctctgcttgttcgtgtgtgtgtcgttgcaggccttattc

SEQ ID NO: 2 - RNA, 62 nt, Artificial Sequence
  5'-UTR_HSD17B4
gucccgcagucggcguccagcggcucugcuuguucgugugugugucguugcaggccuuauuc

SEQ ID NO: 3 - DNA, 42 bp, Artificial Sequence
  5'-UTR_ASAH1
gcctctgctggagtccggggagtggcgttggctgctagagcg

SEQ ID NO: 4 - RNA, 42 nt, Artificial Sequence
  5'-UTR_ASAH1
gccucugcuggaguccggggaguggcguuggcugcuagagcg

SEQ ID NO: 5 - DNA, 75 bp, Artificial Sequence
  5'-UTR_ATP5A1
gcggctcggccattttgtcccagtcagtccggaggctgcggctgcagaagtaccgcctgcggagtaactgcaaag

SEQ ID NO: 6 - RNA, 75 nt, Artificial Sequence
  5'-UTR_ATP5A1
gcggcucggccauuuugucccagucaguccggaggcugcggcugcagaaguaccgccugcggaguaacugcaaag

SEQ ID NO: 7 - DNA, 54 bp, Artificial Sequence
  5'-UTR_Mp68
ctttcccattctgtagcagaatttggtgttgcctgtggtcttggtcccgcggag

SEQ ID NO: 8 - RNA, 54 nt, Artificial Sequence
  5'-UTR_Mp68
cuuucccauucuguagcagaauuugguguugccuguggucuuggucccgcggag

SEQ ID NO: 9 - DNA, 81 bp, Artificial Sequence
  5'-UTR_Ndufa4
gtccgctcagccaggttgcagaagcggcttagcgtgtgtcctaatcttctctctgcgtgtaggtaggcctgtgccgcaaac

SEQ ID NO: 10 - RNA, 81 nt, Artificial Sequence
  5'-UTR_Ndufa4
guccgcucagccagguugcagaagcggcuuagcguguguccuaaucuucucucugcguguagguaggccugugccgcaaac

SEQ ID NO: 11 - DNA, 108 bp, Artificial Sequence
  5'-UTR_Nosip1
ctcctgtcgggcggaagtaggaggagtagagtttaaaaacagtactctttttccggttcgggacgtagttgaagcaacgacaagccggataaccgctcttgagacagg

SEQ ID NO: 12 - RNA, 108 nt, Artificial Sequence
  5'-UTR_Nosip1
cuccugucgggcggaaguaggaggaguagaguuuaaaaacaguacucuuuuuccgguucgggacguaguugaagcaacgacaagccggauaaccgcucuugagacagg

SEQ ID NO: 13 - DNA, 84 bp, Artificial Sequence
  5'-UTR_RPL31.1
cccgtgacccggaagttgtacggctacgcgactttccctcccacaaaccctcgcgcccttcctttcctacttgggcccggcaga

SEQ ID NO: 14 - RNA, 84 nt, Artificial Sequence
  5'-UTR_RPL31.1
cccgugacccggaaguuguacggcuacgcgacuuucccucccacaaacccucgcgcccuuccuuuccuacuugggcccggcaga

SEQ ID NO: 15 - DNA, 159 bp, Artificial Sequence
  5'-UTR_Slc7a3.1
gggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactaga

SEQ ID NO: 16 - RNA, 159 nt, Artificial Sequence
  5'-UTR_Slc7a3.1
gggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuaga

SEQ ID NO: 17 - DNA, 102 bp, Artificial Sequence
  5'-UTR_TUBB4B
atataagcgttggcggagcgtcggttgtagcactctgcgcgcccgctcttctgctgctgtttgtctacttcctcctgcttccccgccgccgccgccgccatc

SEQ ID NO: 18 - RNA, 102 nt, Artificial Sequence
  5'-UTR_TUBB4B
auauaagcguuggcggagcgucgguuguagcacucugcgcgcccgcucuucugcugcuguuugucuacuuccuccugcuuccccgccgccgccgccgccauc

SEQ ID NO: 19 - DNA, 222 bp, Artificial Sequence
  5'-UTR_Ubqln2
cggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgcc

SEQ ID NO: 20 - RNA, 222 nt, Artificial Sequence
  5'-UTR_Ubqln2
cggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgcc

SEQ ID NO: 21 - DNA, 42 bp, Artificial Sequence
  5'-UTR_RPL32
ggcgctgcctacggaggtggcagccatctccttctcggcatc

SEQ ID NO: 22 - RNA, 42 nt, Artificial Sequence
  5'-UTR_RPL32
ggcgcugccuacggagguggcagccaucuccuucucggcauc

SEQ ID NO: 23 - DNA, 57 bp, Artificial Sequence
  3'-UTR_PSMB3.1
ccctgttcccagagcccacttttttttctttttttgaaataaaatagcctgtctttc

SEQ ID NO: 24 - RNA, 57 nt, Artificial Sequence
  3'-UTR_PSMB3.1
cccuguucccagagcccacuuuuuuuucuuuuuuugaaauaaaauagccugucuuuc

SEQ ID NO: 25 - DNA, 121 bp, Artificial Sequence
  3'-UTR_CASP1
aataaggaaactgtatgaatgtctgtgggcaggaagtgaagagatccttctgtaaaggtttttggaattatgtctgctgaataataaacttttttgaaataataaatctggtagaaaaatg

SEQ ID NO: 26 - RNA, 121 nt, Artificial Sequence
  3'-UTR_CASP1
aauaaggaaacuguaugaaugucugugggcaggaagugaagagauccuucuguaaagguuuuuggaauuaugucugcugaauaauaaacuuuuuugaaauaauaaaucugguagaaaaaug

SEQ ID NO: 27 - DNA, 137 bp, Artificial Sequence
  3'-UTR_COXB1
actggctgcatctccctttcctctgtcctccatccttctcccaggatggtgaagggggacctggtacccagtgatccccaccccaggatcctaaatcatgacttacctgctaataaaaactcattggaaaagtgaga

SEQ ID NO: 28 - RNA, 137 nt, Artificial Sequence
  3'-UTR_COXB1
acuggcugcaucucccuuuccucuguccuccauccuucucccaggauggugaagggggaccugguacccagugauccccaccccaggauccuaaaucaugacuuaccugcuaauaaaaacucauuggaaaagugaga

SEQ ID NO: 29 - DNA, 353 bp, Artificial Sequence
  3'-UTR_Gnas
gaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagca

SEQ ID NO: 30 - RNA, 353 nt, Artificial Sequence
  3'-UTR_Gnas
gaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagca

SEQ ID NO: 31 - DNA, 133 bp, Artificial Sequence
  3'-UTR_Ndufa1
ggaagcattttcctggctgattaaaagaaattactcagctatggtcatctgttcctgttagaaggctatgcagcatattatatactatgcgcatgttatgaaatgcataataaaaaattttaaaaaatctaaa

SEQ ID NO: 32 - RNA, 133 nt, Artificial Sequence
  3'-UTR_Ndufa1
ggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaa

SEQ ID NO: 33 - DNA, 70 bp, Artificial Sequence
  3'-UTR_RPS9.1
gtccacctgtccctcctgggctgctggattgtctcgttttcctgccaaataaacaggatcagcgctttac

SEQ ID NO: 34 - RNA, 70 nt, Artificial Sequence
  3'-UTR_RPS9.1
guccaccugucccuccugggcugcuggauugucucguuuuccugccaaauaaacaggaucagcgcuuuac

SEQ ID NO: 35 - DNA, 187 bp, Artificial Sequence
  3'-UTR_ALB7.1
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 36 - RNA, 187 nt, Artificial Sequence
  3'-UTR_ALB7.1
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 37 - DNA, 24 bp, Artificial Sequence
  histone stem-loop
caaaggctcttttcagagccacca

SEQ ID NO: 38 - RNA, 24 nt, Artificial Sequence
  histone stem-loop
caaaggcucuuuucagagccacca

SEQ ID NO: 39 - DNA, 13 bp, Artificial Sequence
  Kozak
gccgccaccatgg

SEQ ID NO: 40 - RNA, 13 nt, Artificial Sequence
  Kozak
gccgccaccaugg

SEQ ID NO: 41 - RNA, 6 nt, Artificial Sequence
  5'-End
gggaga

SEQ ID NO: 42 - protein, 524 aa, Artificial Sequence
  RAV-G
MVPQALLFVPLLVFPLCFGKFPIYTIPDKLGPWSPIDIHHLSCPNNLVVEDEGCTNLSGFSYMELKVGYISAIKMNGFTCTGVVTEAETYTNFVGYVTTTFKRKHFRPTPDACRAAYNWKMAGDPRYEESLHNPYPDYHWLRTVKTTKESLVIISPSVADLDPYDRSLHSRVFPGGNCSGVAVSSTYCSTNHDYTIWMPENPRLGMSCDIFTNSRGKRASKGSETCGFVDERGLYKSLKGACKLKLCGVLGLRLMDGTWVAMQTSNETKWCPPGQLVNLHDFRSDEIEHLVVEELVKKREECLDALESIMTTKSVSFRRLSHLRKLVPGFGKAYTIFNKTLMEADAHYKSVRTWNEIIPSKGCLRVGGRCHPHVNGVFFNGIILGPDGNVLIPEMQSSLLQQHMELLVSSVIPLMHPLADPSTVFKNGDEAEDFVEVHLPDVHERISGVDLGLPNWGKYVLLSAGALTALMLIIFLMTCWRRVNRSEPTQHNLRGTGREVSVTPQSGKIISSWESYKSGGETGL

SEQ ID NO: 43 - protein, 193 aa, Artificial Sequence
  HsEPO
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 44 - protein, 550 aa, Artificial Sequence
  PpLuc
MEDAKNIKKGPAPFYPLEDGTAGEQLHKAMKRYALVPGTIAFTDAHIEVDITYAEYFEMSVRLAEAMKRYGLNTNHRIVVCSENSLQFFMPVLGALFIGVAVAPANDIYNERELLNSMGISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKIAV

SEQ ID NO: 45 - protein, 553 aa, Artificial Sequence
  HRSV
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 46 - RNA, 1575 nt, Artificial Sequence
  RAV-G
augguuccucaggcucuccuguuuguaccccuucugguuuuuccauuguguuuugggaaauucccuauuuacacgauaccagacaagcuuggucccuggagcccgauugacauacaucaccucagcugcccaaacaauuugguaguggaggacgaaggaugcaccaaccugucaggguucuccuacauggaacuuaaaguuggauacaucucagccauaaaaaugaacggguucacuugcacaggcguugugacggaggcugaaaccuacacuaacuucguugguuaugucacaaccacguucaaaagaaagcauuuccgcccaacaccagaugcauguagagccgcguacaacuggaagauggccggugaccccagauaugaagagucucuacacaauccguacccugacuaccacuggcuucgaacuguaaaaaccaccaaggagucucucguuaucauaucuccaaguguggcagauuuggacccauaugacagaucccuucacucgagggucuucccuggcgggaauugcucaggaguagcggugucuucuaccuacugcuccacuaaccacgauuacaccauuuggaugcccgagaauccgagacuagggaugucuugugacauuuuuaccaauaguagagggaagagagcauccaaagggagugagacuugcggcuuuguagaugaaagaggccuauauaagucuuuaaaaggagcaugcaaacucaaguuauguggaguucuaggacuuagacuuauggauggaacaugggucgcgaugcaaacaucaaaugaaaccaaauggugcccucccggucaguuggugaauuugcacgacuuucgcucagacgaaauugagcaccuuguuguagaggaguuggucaagaagagagaggagugucuggaugcacuagaguccaucaugaccaccaagucagugaguuucagacgucucagucauuuaagaaaacuugucccuggguuuggaaaagcauauaccauauucaacaagaccuugauggaagccgaugcucacuacaagucagucagaacuuggaaugagaucaucccuucaaaaggguguuuaagaguuggggggaggugucauccucauguaaacgggguauuuuucaaugguauaauauuaggaccugacggcaaugucuuaaucccagagaugcaaucaucccuccuccagcaacauauggaguuguugguauccucgguuaucccccuuaugcacccccuggcagacccgucuaccguuuucaagaacggugacgaggcugaggauuuuguugaaguucaccuucccgaugugcacgaacggaucucaggaguugacuugggucucccgaacugggggaaguauguauuacugagugcaggggcccugacugccuugauguugauaauuuuccugaugacaugcuggagaagagucaaucgaucggaaccuacacaacacaaucucagagggacagggagggaggugucagucacuccccaaagcgggaagaucauaucuucaugggaaucauacaagagcgggggugagaccggacuguga

SEQ ID NO: 47 - RNA, 582 nt, Artificial Sequence
  HsEPO
augggggugcacgaauguccugccuggcuguggcuucuccugucccugcugucgcucccucugggccucccaguccugggcgccccaccacgccucaucugugacagccgaguccuggagagguaccucuuggaggccaaggaggccgagaauaucacgacgggcugugcugaacacugcagcuugaaugagaauaucacugucccagacaccaaaguuaauuucuaugccuggaagaggauggaggucgggcagcaggccguagaagucuggcagggccuggcccugcugucggaagcuguccugcggggccaggcccuguuggucaacucuucccagccgugggagccccugcagcugcauguggauaaagccgucaguggccuucgcagccucaccacucugcuucgggcucugggagcccagaaggaagccaucuccccuccagaugcggccucagcugcuccacuccgaacaaucacugcugacacuuuccgcaaacucuuccgagucuacuccaauuuccuccggggaaagcugaagcuguacacaggggaggccugcaggacaggggacagauga

SEQ ID NO: 48 - RNA, 1653 nt, Artificial Sequence
  PpLuc
auggaagacgccaaaaacauaaagaaaggcccggcgccauucuauccgcuggaagauggaaccgcuggagagcaacugcauaaggcuaugaagagauacgcccugguuccuggaacaauugcuuuuacagaugcacauaucgagguggacaucacuuacgcugaguacuucgaaauguccguucgguuggcagaagcuaugaaacgauaugggcugaauacaaaucacagaaucgucguaugcagugaaaacucucuucaauucuuuaugccgguguugggcgcguuauuuaucggaguugcaguugcgcccgcgaacgacauuuauaaugaacgugaauugcucaacaguaugggcauuucgcagccuaccgugguguucguuuccaaaaagggguugcaaaaaauuuugaacgugcaaaaaaagcucccaaucauccaaaaaauuauuaucauggauucuaaaacggauuaccagggauuucagucgauguacacguucgucacaucucaucuaccucccgguuuuaaugaauacgauuuugugccagaguccuucgauagggacaagacaauugcacugaucaugaacuccucuggaucuacuggucugccuaaaggugucgcucugccucauagaacugccugcgugagauucucgcaugccagagauccuauuuuuggcaaucaaaucauuccggauacugcgauuuuaaguguuguuccauuccaucacgguuuuggaauguuuacuacacucggauauuugauauguggauuucgagucgucuuaauguauagauuugaagaagagcuguuucugaggagccuucaggauuacaagauucaaagugcgcugcuggugccaacccuauucuccuucuucgccaaaagcacucugauugacaaauacgauuuaucuaauuuacacgaaauugcuucugguggcgcuccccucucuaaggaagucggggaagcgguugccaagagguuccaucugccagguaucaggcaaggauaugggcucacugagacuacaucagcuauucugauuacacccgagggggaugauaaaccgggcgcggucgguaaaguuguuccauuuuuugaagcgaagguuguggaucuggauaccgggaaaacgcugggcguuaaucaaagaggcgaacugugugugagagguccuaugauuauguccgguuauguaaacaauccggaagcgaccaacgccuugauugacaaggauggauggcuacauucuggagacauagcuuacugggacgaagacgaacacuucuucaucguugaccgccugaagucucugauuaaguacaaaggcuaucagguggcucccgcugaauuggaauccaucuugcuccaacaccccaacaucuucgacgcaggugucgcaggucuucccgacgaugacgccggugaacuucccgccgccguuguuguuuuggagcacggaaagacgaugacggaaaaagagaucguggauuacgucgccagucaaguaacaaccgcgaaaaaguugcgcggaggaguuguguuuguggacgaaguaccgaaaggucuuaccggaaaacucgacgcaagaaaaaucagagagauccucauaaaggccaagaagggcggaaagaucgccguguaa

SEQ ID NO: 49 - RNA, 1662 nt, Artificial Sequence
  HRSV
auggaguugcuaauccucaaagcaaaugcaauuaccacaauccucacugcagucacauuuuguuuugcuucuggucaaaacaucacugaagaauuuuaucaaucaacaugcagugcaguuagcaaaggcuaucuuagugcucugagaacugguugguauaccaguguuauaacuauagaauuaaguaauaucaaggaaaauaaguguaauggaacagaugcuaagguaaaauugauaaaacaagaauuagauaaauauaaaaaugcuguaacagaauugcaguugcucaugcaaagcacaccagcaacaaacaaucgagccagaagagaacuaccaagguuuaugaauuauacacucaacaaugccaaaaaaaccaauguaacauuaagcaagaaaaggaaaagaagauuucuugguuuuuuguuagguguuggaucugcaaucgccaguggcguugcuguaugcaagguccugcaccuagaaggggaagugaacaagaucaaaagugcucuacuauccacaaacaaggcuguagucagcuuaucaaauggaguuagugucuuaaccuucaaaguguuagaccucaaaaacuauauagauaaacaauuguuaccuauucugaacaagcaaagcugcagcauaucaaauauagaaacugugauagaguuccaacaaaagaacaacagacuacuagagauuaccagggaauuuaguguuaaugcagguguaacuacaccuguaagcacuuacauguuaacuaauagugaauuauugucauuaaucaaugauaugccuauaacaaaugaucagaaaaaguuaauguccaacaauguucaaauaguuagacagcaaaguuacucuaucaugugcauaauaaaagaggaagucuuagcauauguaguacaauuaccacuauaugguguuauagauacacccuguuggaaacuacacacauccccucuauguacaaccaacacaaaagaaggguccaacaucuguuuaacaagaacugacagaggaugguacugugacaaugcaggaucaguaucuuucuucccacaagcugaaacauguaaaguucaaucaaaucgaguauuuugugacacaaugaacaguuuaacauuaccaagugaaguaaaucucugcaauguugacauauucaaccccaaauaugauuguaaaauuaugacuucaaaaacagauguaagcagcuccguuaucacaucucuaggagccauugugucaugcuauggcaaaacuaaauguacagcauccaauaaaaaucguggaaucauaaagacauuuucuaacgggugcgauuauguaucaaauaaagggguggacacugugucuguagguaacacauuauauuauguaaauaagcaagaagguaaaagucucuauguaaaaggugaaccaauaauaaauuucuaugacccauuaguauuccccucugaugaauuugaugcaucaauaucucaagucaacgagaagauuaaccagagccuagcauuuauucguaaauccgaugaauuauuacauaauguaaaugcugguaaauccaccacaaauaucaugauaacuacuauaauuauagugauuauaguaauauuguuaucauuaauugcuguuggacugcucuuauacuguaaggccagauaa

SEQ ID NO: 50 - RNA, 1575 nt, Artificial Sequence
  RAV-G
auggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcuguga

SEQ ID NO: 51 - RNA, 582 nt, Artificial Sequence
  HsEPO
augggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccgguga

SEQ ID NO: 52 - RNA, 1653 nt, Artificial Sequence
  PpLuc
auggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccguguga

SEQ ID NO: 53 - RNA, 1662 nt, Artificial Sequence
  HRSV
auggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccgguga

SEQ ID NO: 54 - RNA, 1851 nt, Artificial Sequence
  RAV-G variant
gggagagucccgcagucggcguccagcggcucugcuuguucgugugugugucguugcaggccuuauucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 55 - RNA, 1792 nt, Artificial Sequence
  RAV-G variant
gggagagucccgcagucggcguccagcggcucugcuuguucgugugugugucguugcaggccuuauucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 56 - RNA, 858 nt, Artificial Sequence
  HsEPO variant
gggagagucccgcagucggcguccagcggcucugcuuguucgugugugugucguugcaggccuuauucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 57 - RNA, 799 nt, Artificial Sequence
  HsEPO variant
gggagagucccgcagucggcguccagcggcucugcuuguucgugugugugucguugcaggccuuauucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 58 - RNA, 1929 nt, Artificial Sequence
  PpLuc variant
gggagagucccgcagucggcguccagcggcucugcuuguucgugugugugucguugcaggccuuauucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 59 - RNA, 1870 nt, Artificial Sequence
  PpLuc variant
gggagagucccgcagucggcguccagcggcucugcuuguucgugugugugucguugcaggccuuauucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 60 - RNA, 1938 nt, Artificial Sequence
  HRSV variant
gggagagucccgcagucggcguccagcggcucugcuuguucgugugugugucguugcaggccuuauucaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61 - RNA, 1915 nt, Artificial Sequence
  RAV-G variant
gggagagucccgcagucggcguccagcggcucugcuuguucgugugugugucguugcaggccuuauucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 62 - RNA, 1856 nt, Artificial Sequence
  RAV-G variant
gggagagucccgcagucggcguccagcggcucugcuuguucgugugugugucguugcaggccuuauucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 63 - RNA, 922 nt, Artificial Sequence
  HsEPO variant
gggagagucccgcagucggcguccagcggcucugcuuguucgugugugugucguugcaggccuuauucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 64 - RNA, 863 nt, Artificial Sequence
  HsEPO variant
gggagagucccgcagucggcguccagcggcucugcuuguucgugugugugucguugcaggccuuauucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 65 - RNA, 1993 nt, Artificial Sequence
  PpLuc variant
gggagagucccgcagucggcguccagcggcucugcuuguucgugugugugucguugcaggccuuauucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 66 - RNA, 1934 nt, Artificial Sequence
  PpLuc variant
gggagagucccgcagucggcguccagcggcucugcuuguucgugugugugucguugcaggccuuauucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 67 - RNA, 2002 nt, Artificial Sequence
  HRSV variant
gggagagucccgcagucggcguccagcggcucugcuuguucgugugugugucguugcaggccuuauucaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 68 - RNA, 1931 nt, Artificial Sequence
  RAV-G variant
gggagagucccgcagucggcguccagcggcucugcuuguucgugugugugucguugcaggccuuauucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 69 - RNA, 1872 nt, Artificial Sequence
  RAV-G variant
gggagagucccgcagucggcguccagcggcucugcuuguucgugugugugucguugcaggccuuauucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 70 - RNA, 938 nt, Artificial Sequence
  HsEPO variant
gggagagucccgcagucggcguccagcggcucugcuuguucgugugugugucguugcaggccuuauucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 71 - RNA, 879 nt, Artificial Sequence
  HsEPO variant
gggagagucccgcagucggcguccagcggcucugcuuguucgugugugugucguugcaggccuuauucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 72 - RNA, 2009 nt, Artificial Sequence
  PpLuc variant
gggagagucccgcagucggcguccagcggcucugcuuguucgugugugugucguugcaggccuuauucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 73 - RNA, 1950 nt, Artificial Sequence
  PpLuc variant
gggagagucccgcagucggcguccagcggcucugcuuguucgugugugugucguugcaggccuuauucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 74 - RNA, 2018 nt, Artificial Sequence
  HRSV variant
gggagagucccgcagucggcguccagcggcucugcuuguucgugugugugucguugcaggccuuauucaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 75 - RNA, 2147 nt, Artificial Sequence
  RAV-G variant
gggagagucccgcagucggcguccagcggcucugcuuguucgugugugugucguugcaggccuuauucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 76 - RNA, 2088 nt, Artificial Sequence
  RAV-G variant
gggagagucccgcagucggcguccagcggcucugcuuguucgugugugugucguugcaggccuuauucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 77 - RNA, 1154 nt, Artificial Sequence
  HsEPO variant
gggagagucccgcagucggcguccagcggcucugcuuguucgugugugugucguugcaggccuuauucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 78 - RNA, 1095 nt, Artificial Sequence
  HsEPO variant
gggagagucccgcagucggcguccagcggcucugcuuguucgugugugugucguugcaggccuuauucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 79 - RNA, 2225 nt, Artificial Sequence
  PpLuc variant
gggagagucccgcagucggcguccagcggcucugcuuguucgugugugugucguugcaggccuuauucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 80 - RNA, 2166 nt, Artificial Sequence
  PpLuc variant
gggagagucccgcagucggcguccagcggcucugcuuguucgugugugugucguugcaggccuuauucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 81 - RNA, 2234 nt, Artificial Sequence
  HRSV variant
gggagagucccgcagucggcguccagcggcucugcuuguucgugugugugucguugcaggccuuauucaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 82 - RNA, 1927 nt, Artificial Sequence
  RAV-G variant
gggagagucccgcagucggcguccagcggcucugcuuguucgugugugugucguugcaggccuuauucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 83 - RNA, 1868 nt, Artificial Sequence
  RAV-G variant
gggagagucccgcagucggcguccagcggcucugcuuguucgugugugugucguugcaggccuuauucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 84 - RNA, 934 nt, Artificial Sequence
  HsEPO variant
gggagagucccgcagucggcguccagcggcucugcuuguucgugugugugucguugcaggccuuauucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 85 - RNA, 875 nt, Artificial Sequence
  HsEPO variant
gggagagucccgcagucggcguccagcggcucugcuuguucgugugugugucguugcaggccuuauucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 86 - RNA, 2005 nt, Artificial Sequence
  PpLuc variant
gggagagucccgcagucggcguccagcggcucugcuuguucgugugugugucguugcaggccuuauucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 87 - RNA, 1946 nt, Artificial Sequence
  PpLuc variant
gggagagucccgcagucggcguccagcggcucugcuuguucgugugugugucguugcaggccuuauucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 88 - RNA, 2014 nt, Artificial Sequence
  HRSV variant
gggagagucccgcagucggcguccagcggcucugcuuguucgugugugugucguugcaggccuuauucaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 89 - RNA, 1864 nt, Artificial Sequence
  RAV-G variant
gggagagucccgcagucggcguccagcggcucugcuuguucgugugugugucguugcaggccuuauucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 90 - RNA, 1805 nt, Artificial Sequence
  RAV-G variant
gggagagucccgcagucggcguccagcggcucugcuuguucgugugugugucguugcaggccuuauucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 91 - RNA, 871 nt, Artificial Sequence
  HsEPO variant
gggagagucccgcagucggcguccagcggcucugcuuguucgugugugugucguugcaggccuuauucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 92 - RNA, 812 nt, Artificial Sequence
  HsEPO variant
gggagagucccgcagucggcguccagcggcucugcuuguucgugugugugucguugcaggccuuauucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 93 - RNA, 1942 nt, Artificial Sequence
  PpLuc variant
gggagagucccgcagucggcguccagcggcucugcuuguucgugugugugucguugcaggccuuauucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 94 - RNA, 1883 nt, Artificial Sequence
  PpLuc variant
gggagagucccgcagucggcguccagcggcucugcuuguucgugugugugucguugcaggccuuauucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 95 - RNA, 1951 nt, Artificial Sequence
  HRSV variant
gggagagucccgcagucggcguccagcggcucugcuuguucgugugugugucguugcaggccuuauucaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 96 - RNA, 1844 nt, Artificial Sequence
  RAV-G variant
gggagagccucugcuggaguccggggaguggcguuggcugcuagagcgaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 97 - RNA, 1785 nt, Artificial Sequence
  RAV-G variant
gggagagccucugcuggaguccggggaguggcguuggcugcuagagcgaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 98 - RNA, 851 nt, Artificial Sequence
  HsEPO variant
gggagagccucugcuggaguccggggaguggcguuggcugcuagagcgaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 99 - RNA, 792 nt, Artificial Sequence
  HsEPO variant
gggagagccucugcuggaguccggggaguggcguuggcugcuagagcgaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 100 - RNA, 1922 nt, Artificial Sequence
  PpLuc variant
gggagagccucugcuggaguccggggaguggcguuggcugcuagagcgaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 101 - RNA, 1863 nt, Artificial Sequence
  PpLuc variant
gggagagccucugcuggaguccggggaguggcguuggcugcuagagcgaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 102 - RNA, 1931 nt, Artificial Sequence
  HRSV variant
gggagagccucugcuggaguccggggaguggcguuggcugcuagagcgaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 103 - RNA, 1864 nt, Artificial Sequence
  RAV-G variant
gggagagcggcucggccauuuugucccagucaguccggaggcugcggcugcagaaguaccgccugcggaguaacugcaaagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 104 - RNA, 1805 nt, Artificial Sequence
  RAV-G variant
gggagagcggcucggccauuuugucccagucaguccggaggcugcggcugcagaaguaccgccugcggaguaacugcaaagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 105 - RNA, 871 nt, Artificial Sequence
  HsEPO variant
gggagagcggcucggccauuuugucccagucaguccggaggcugcggcugcagaaguaccgccugcggaguaacugcaaagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 106 - RNA, 812 nt, Artificial Sequence
  HsEPO variant
gggagagcggcucggccauuuugucccagucaguccggaggcugcggcugcagaaguaccgccugcggaguaacugcaaagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 107 - RNA, 1942 nt, Artificial Sequence
  PpLuc variant
gggagagcggcucggccauuuugucccagucaguccggaggcugcggcugcagaaguaccgccugcggaguaacugcaaagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 108 - RNA, 1883 nt, Artificial Sequence
  PpLuc variant
gggagagcggcucggccauuuugucccagucaguccggaggcugcggcugcagaaguaccgccugcggaguaacugcaaagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 109 - RNA, 1951 nt, Artificial Sequence
  HRSV variant
gggagagcggcucggccauuuugucccagucaguccggaggcugcggcugcagaaguaccgccugcggaguaacugcaaagaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 110 - RNA, 1928 nt, Artificial Sequence
  RAV-G variant
gggagagcggcucggccauuuugucccagucaguccggaggcugcggcugcagaaguaccgccugcggaguaacugcaaagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 111 - RNA, 1869 nt, Artificial Sequence
  RAV-G variant
gggagagcggcucggccauuuugucccagucaguccggaggcugcggcugcagaaguaccgccugcggaguaacugcaaagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 112 - RNA, 935 nt, Artificial Sequence
  HsEPO variant
gggagagcggcucggccauuuugucccagucaguccggaggcugcggcugcagaaguaccgccugcggaguaacugcaaagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 113 - RNA, 876 nt, Artificial Sequence
  HsEPO variant
gggagagcggcucggccauuuugucccagucaguccggaggcugcggcugcagaaguaccgccugcggaguaacugcaaagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 114 - RNA, 2006 nt, Artificial Sequence
  PpLuc variant
gggagagcggcucggccauuuugucccagucaguccggaggcugcggcugcagaaguaccgccugcggaguaacugcaaagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 115 - RNA, 1947 nt, Artificial Sequence
  PpLuc variant
gggagagcggcucggccauuuugucccagucaguccggaggcugcggcugcagaaguaccgccugcggaguaacugcaaagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 116 - RNA, 2015 nt, Artificial Sequence
  HRSV variant
gggagagcggcucggccauuuugucccagucaguccggaggcugcggcugcagaaguaccgccugcggaguaacugcaaagaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 117 - RNA, 1944 nt, Artificial Sequence
  RAV-G variant
gggagagcggcucggccauuuugucccagucaguccggaggcugcggcugcagaaguaccgccugcggaguaacugcaaagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 118 - RNA, 1885 nt, Artificial Sequence
  RAV-G variant
gggagagcggcucggccauuuugucccagucaguccggaggcugcggcugcagaaguaccgccugcggaguaacugcaaagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 119 - RNA, 951 nt, Artificial Sequence
  HsEPO variant
gggagagcggcucggccauuuugucccagucaguccggaggcugcggcugcagaaguaccgccugcggaguaacugcaaagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 120 - RNA, 892 nt, Artificial Sequence
  HsEPO variant
gggagagcggcucggccauuuugucccagucaguccggaggcugcggcugcagaaguaccgccugcggaguaacugcaaagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 121 - RNA, 2022 nt, Artificial Sequence
  PpLuc variant
gggagagcggcucggccauuuugucccagucaguccggaggcugcggcugcagaaguaccgccugcggaguaacugcaaagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 122 - RNA, 1963 nt, Artificial Sequence
  PpLuc variant
gggagagcggcucggccauuuugucccagucaguccggaggcugcggcugcagaaguaccgccugcggaguaacugcaaagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 123 - RNA, 2031 nt, Artificial Sequence
  HRSV variant
gggagagcggcucggccauuuugucccagucaguccggaggcugcggcugcagaaguaccgccugcggaguaacugcaaagaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 124 - RNA, 2160 nt, Artificial Sequence
  RAV-G variant
gggagagcggcucggccauuuugucccagucaguccggaggcugcggcugcagaaguaccgccugcggaguaacugcaaagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 125 - RNA, 2101 nt, Artificial Sequence
  RAV-G variant
gggagagcggcucggccauuuugucccagucaguccggaggcugcggcugcagaaguaccgccugcggaguaacugcaaagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 126 - RNA, 1167 nt, Artificial Sequence
  HsEPO variant
gggagagcggcucggccauuuugucccagucaguccggaggcugcggcugcagaaguaccgccugcggaguaacugcaaagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 127 - RNA, 1108 nt, Artificial Sequence
  HsEPO variant
gggagagcggcucggccauuuugucccagucaguccggaggcugcggcugcagaaguaccgccugcggaguaacugcaaagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 128 - RNA, 2238 nt, Artificial Sequence
  PpLuc variant
gggagagcggcucggccauuuugucccagucaguccggaggcugcggcugcagaaguaccgccugcggaguaacugcaaagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 129 - RNA, 2179 nt, Artificial Sequence
  PpLuc variant
gggagagcggcucggccauuuugucccagucaguccggaggcugcggcugcagaaguaccgccugcggaguaacugcaaagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 130 - RNA, 2247 nt, Artificial Sequence
  HRSV variant
gggagagcggcucggccauuuugucccagucaguccggaggcugcggcugcagaaguaccgccugcggaguaacugcaaagaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 131 - RNA, 1940 nt, Artificial Sequence
  RAV-G variant
gggagagcggcucggccauuuugucccagucaguccggaggcugcggcugcagaaguaccgccugcggaguaacugcaaagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 132 - RNA, 1881 nt, Artificial Sequence
  RAV-G variant
gggagagcggcucggccauuuugucccagucaguccggaggcugcggcugcagaaguaccgccugcggaguaacugcaaagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 133 - RNA, 947 nt, Artificial Sequence
  HsEPO variant
gggagagcggcucggccauuuugucccagucaguccggaggcugcggcugcagaaguaccgccugcggaguaacugcaaagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 134 - RNA, 888 nt, Artificial Sequence
  HsEPO variant
gggagagcggcucggccauuuugucccagucaguccggaggcugcggcugcagaaguaccgccugcggaguaacugcaaagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 135 - RNA, 2018 nt, Artificial Sequence
  PpLuc variant
gggagagcggcucggccauuuugucccagucaguccggaggcugcggcugcagaaguaccgccugcggaguaacugcaaagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 136 - RNA, 1959 nt, Artificial Sequence
  PpLuc variant
gggagagcggcucggccauuuugucccagucaguccggaggcugcggcugcagaaguaccgccugcggaguaacugcaaagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 137 - RNA, 2027 nt, Artificial Sequence
  HRSV variant
gggagagcggcucggccauuuugucccagucaguccggaggcugcggcugcagaaguaccgccugcggaguaacugcaaagaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 138 - RNA, 1877 nt, Artificial Sequence
  RAV-G variant
gggagagcggcucggccauuuugucccagucaguccggaggcugcggcugcagaaguaccgccugcggaguaacugcaaagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 139 - RNA, 1818 nt, Artificial Sequence
  RAV-G variant
gggagagcggcucggccauuuugucccagucaguccggaggcugcggcugcagaaguaccgccugcggaguaacugcaaagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 140 - RNA, 884 nt, Artificial Sequence
  HsEPO variant
gggagagcggcucggccauuuugucccagucaguccggaggcugcggcugcagaaguaccgccugcggaguaacugcaaagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 141 - RNA, 825 nt, Artificial Sequence
  HsEPO variant
gggagagcggcucggccauuuugucccagucaguccggaggcugcggcugcagaaguaccgccugcggaguaacugcaaagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 142 - RNA, 1955 nt, Artificial Sequence
  PpLuc variant
gggagagcggcucggccauuuugucccagucaguccggaggcugcggcugcagaaguaccgccugcggaguaacugcaaagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 143 - RNA, 1896 nt, Artificial Sequence
  PpLuc variant
gggagagcggcucggccauuuugucccagucaguccggaggcugcggcugcagaaguaccgccugcggaguaacugcaaagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 144 - RNA, 1964 nt, Artificial Sequence
  HRSV variant
gggagagcggcucggccauuuugucccagucaguccggaggcugcggcugcagaaguaccgccugcggaguaacugcaaagaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 145 - RNA, 1843 nt, Artificial Sequence
  RAV-G variant
gggagacuuucccauucuguagcagaauuugguguugccuguggucuuggucccgcggagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 146 - RNA, 1784 nt, Artificial Sequence
  RAV-G variant
gggagacuuucccauucuguagcagaauuugguguugccuguggucuuggucccgcggagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 147 - RNA, 850 nt, Artificial Sequence
  HsEPO variant
gggagacuuucccauucuguagcagaauuugguguugccuguggucuuggucccgcggagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 148 - RNA, 791 nt, Artificial Sequence
  HsEPO variant
gggagacuuucccauucuguagcagaauuugguguugccuguggucuuggucccgcggagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 149 - RNA, 1921 nt, Artificial Sequence
  PpLuc variant
gggagacuuucccauucuguagcagaauuugguguugccuguggucuuggucccgcggagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 150 - RNA, 1862 nt, Artificial Sequence
  PpLuc variant
gggagacuuucccauucuguagcagaauuugguguugccuguggucuuggucccgcggagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 151 - RNA, 1930 nt, Artificial Sequence
  HRSV variant
gggagacuuucccauucuguagcagaauuugguguugccuguggucuuggucccgcggagaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 152 - RNA, 1907 nt, Artificial Sequence
  RAV-G variant
gggagacuuucccauucuguagcagaauuugguguugccuguggucuuggucccgcggagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 153 - RNA, 1848 nt, Artificial Sequence
  RAV-G variant
gggagacuuucccauucuguagcagaauuugguguugccuguggucuuggucccgcggagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 154 - RNA, 914 nt, Artificial Sequence
  HsEPO variant
gggagacuuucccauucuguagcagaauuugguguugccuguggucuuggucccgcggagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 155 - RNA, 855 nt, Artificial Sequence
  HsEPO variant
gggagacuuucccauucuguagcagaauuugguguugccuguggucuuggucccgcggagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 156 - RNA, 1985 nt, Artificial Sequence
  PpLuc variant
gggagacuuucccauucuguagcagaauuugguguugccuguggucuuggucccgcggagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 157 - RNA, 1926 nt, Artificial Sequence
  PpLuc variant
gggagacuuucccauucuguagcagaauuugguguugccuguggucuuggucccgcggagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 158 - RNA, 1994 nt, Artificial Sequence
  HRSV variant
gggagacuuucccauucuguagcagaauuugguguugccuguggucuuggucccgcggagaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 159 - RNA, 1923 nt, Artificial Sequence
  RAV-G variant
gggagacuuucccauucuguagcagaauuugguguugccuguggucuuggucccgcggagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 160 - RNA, 1864 nt, Artificial Sequence
  RAV-G variant
gggagacuuucccauucuguagcagaauuugguguugccuguggucuuggucccgcggagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 161 - RNA, 930 nt, Artificial Sequence
  HsEPO variant
gggagacuuucccauucuguagcagaauuugguguugccuguggucuuggucccgcggagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 162 - RNA, 871 nt, Artificial Sequence
  HsEPO variant
gggagacuuucccauucuguagcagaauuugguguugccuguggucuuggucccgcggagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 163 - RNA, 2001 nt, Artificial Sequence
  PpLuc variant
gggagacuuucccauucuguagcagaauuugguguugccuguggucuuggucccgcggagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 164 - RNA, 1942 nt, Artificial Sequence
  PpLuc variant
gggagacuuucccauucuguagcagaauuugguguugccuguggucuuggucccgcggagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 165 - RNA, 2010 nt, Artificial Sequence
  HRSV variant
gggagacuuucccauucuguagcagaauuugguguugccuguggucuuggucccgcggagaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 166 - RNA, 2139 nt, Artificial Sequence
  RAV-G variant
gggagacuuucccauucuguagcagaauuugguguugccuguggucuuggucccgcggagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 167 - RNA, 2080 nt, Artificial Sequence
  RAV-G variant
gggagacuuucccauucuguagcagaauuugguguugccuguggucuuggucccgcggagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 168 - RNA, 1146 nt, Artificial Sequence
  HsEPO variant
gggagacuuucccauucuguagcagaauuugguguugccuguggucuuggucccgcggagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 169 - RNA, 1087 nt, Artificial Sequence
  HsEPO variant
gggagacuuucccauucuguagcagaauuugguguugccuguggucuuggucccgcggagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 170 - RNA, 2217 nt, Artificial Sequence
  PpLuc variant
gggagacuuucccauucuguagcagaauuugguguugccuguggucuuggucccgcggagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 171 - RNA, 2158 nt, Artificial Sequence
  PpLuc variant
gggagacuuucccauucuguagcagaauuugguguugccuguggucuuggucccgcggagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 172 - RNA, 2226 nt, Artificial Sequence
  HRSV variant
gggagacuuucccauucuguagcagaauuugguguugccuguggucuuggucccgcggagaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 173 - RNA, 1919 nt, Artificial Sequence
  RAV-G variant
gggagacuuucccauucuguagcagaauuugguguugccuguggucuuggucccgcggagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 174 - RNA, 1860 nt, Artificial Sequence
  RAV-G variant
gggagacuuucccauucuguagcagaauuugguguugccuguggucuuggucccgcggagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 175 - RNA, 926 nt, Artificial Sequence
  HsEPO variant
gggagacuuucccauucuguagcagaauuugguguugccuguggucuuggucccgcggagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 176 - RNA, 867 nt, Artificial Sequence
  HsEPO variant
gggagacuuucccauucuguagcagaauuugguguugccuguggucuuggucccgcggagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 177 - RNA, 1997 nt, Artificial Sequence
  PpLuc variant
gggagacuuucccauucuguagcagaauuugguguugccuguggucuuggucccgcggagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 178 - RNA, 1938 nt, Artificial Sequence
  PpLuc variant
gggagacuuucccauucuguagcagaauuugguguugccuguggucuuggucccgcggagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 179 - RNA, 2006 nt, Artificial Sequence
  HRSV variant
gggagacuuucccauucuguagcagaauuugguguugccuguggucuuggucccgcggagaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 180 - RNA, 1856 nt, Artificial Sequence
  RAV-G variant
gggagacuuucccauucuguagcagaauuugguguugccuguggucuuggucccgcggagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 181 - RNA, 1797 nt, Artificial Sequence
  RAV-G variant
gggagacuuucccauucuguagcagaauuugguguugccuguggucuuggucccgcggagaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 182 - RNA, 863 nt, Artificial Sequence
  HsEPO variant
gggagacuuucccauucuguagcagaauuugguguugccuguggucuuggucccgcggagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 183 - RNA, 804 nt, Artificial Sequence
  HsEPO variant
gggagacuuucccauucuguagcagaauuugguguugccuguggucuuggucccgcggagaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 184 - RNA, 1934 nt, Artificial Sequence
  PpLuc variant
gggagacuuucccauucuguagcagaauuugguguugccuguggucuuggucccgcggagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 185 - RNA, 1875 nt, Artificial Sequence
  PpLuc variant
gggagacuuucccauucuguagcagaauuugguguugccuguggucuuggucccgcggagaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 186 - RNA, 1943 nt, Artificial Sequence
  HRSV variant
gggagacuuucccauucuguagcagaauuugguguugccuguggucuuggucccgcggagaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 187 - RNA, 1870 nt, Artificial Sequence
  RAV-G variant
gggagaguccgcucagccagguugcagaagcggcuuagcguguguccuaaucuucucucugcguguagguaggccugugccgcaaacaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 188 - RNA, 1811 nt, Artificial Sequence
  RAV-G variant
gggagaguccgcucagccagguugcagaagcggcuuagcguguguccuaaucuucucucugcguguagguaggccugugccgcaaacaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 189 - RNA, 877 nt, Artificial Sequence
  HsEPO variant
gggagaguccgcucagccagguugcagaagcggcuuagcguguguccuaaucuucucucugcguguagguaggccugugccgcaaacaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 190 - RNA, 818 nt, Artificial Sequence
  HsEPO variant
gggagaguccgcucagccagguugcagaagcggcuuagcguguguccuaaucuucucucugcguguagguaggccugugccgcaaacaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 191 - RNA, 1948 nt, Artificial Sequence
  PpLuc variant
gggagaguccgcucagccagguugcagaagcggcuuagcguguguccuaaucuucucucugcguguagguaggccugugccgcaaacaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 192 - RNA, 1889 nt, Artificial Sequence
  PpLuc variant
gggagaguccgcucagccagguugcagaagcggcuuagcguguguccuaaucuucucucugcguguagguaggccugugccgcaaacaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 193 - RNA, 1957 nt, Artificial Sequence
  HRSV variant
gggagaguccgcucagccagguugcagaagcggcuuagcguguguccuaaucuucucucugcguguagguaggccugugccgcaaacaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 194 - RNA, 1934 nt, Artificial Sequence
  RAV-G variant
gggagaguccgcucagccagguugcagaagcggcuuagcguguguccuaaucuucucucugcguguagguaggccugugccgcaaacaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 195 - RNA, 1875 nt, Artificial Sequence
  RAV-G variant
gggagaguccgcucagccagguugcagaagcggcuuagcguguguccuaaucuucucucugcguguagguaggccugugccgcaaacaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 196 - RNA, 941 nt, Artificial Sequence
  HsEPO variant
gggagaguccgcucagccagguugcagaagcggcuuagcguguguccuaaucuucucucugcguguagguaggccugugccgcaaacaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 197 - RNA, 882 nt, Artificial Sequence
  HsEPO variant
gggagaguccgcucagccagguugcagaagcggcuuagcguguguccuaaucuucucucugcguguagguaggccugugccgcaaacaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 198 - RNA, 2012 nt, Artificial Sequence
  PpLuc variant
gggagaguccgcucagccagguugcagaagcggcuuagcguguguccuaaucuucucucugcguguagguaggccugugccgcaaacaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 199 - RNA, 1953 nt, Artificial Sequence
  PpLuc variant
gggagaguccgcucagccagguugcagaagcggcuuagcguguguccuaaucuucucucugcguguagguaggccugugccgcaaacaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 200 - RNA, 2021 nt, Artificial Sequence
  HRSV variant
gggagaguccgcucagccagguugcagaagcggcuuagcguguguccuaaucuucucucugcguguagguaggccugugccgcaaacaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 201 - RNA, 1950 nt, Artificial Sequence
  RAV-G variant
gggagaguccgcucagccagguugcagaagcggcuuagcguguguccuaaucuucucucugcguguagguaggccugugccgcaaacaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 202 - RNA, 1891 nt, Artificial Sequence
  RAV-G variant
gggagaguccgcucagccagguugcagaagcggcuuagcguguguccuaaucuucucucugcguguagguaggccugugccgcaaacaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 203 - RNA, 957 nt, Artificial Sequence
  HsEPO variant
gggagaguccgcucagccagguugcagaagcggcuuagcguguguccuaaucuucucucugcguguagguaggccugugccgcaaacaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 204 - RNA, 898 nt, Artificial Sequence
  HsEPO variant
gggagaguccgcucagccagguugcagaagcggcuuagcguguguccuaaucuucucucugcguguagguaggccugugccgcaaacaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 205 - RNA, 2028 nt, Artificial Sequence
  PpLuc variant
gggagaguccgcucagccagguugcagaagcggcuuagcguguguccuaaucuucucucugcguguagguaggccugugccgcaaacaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 206 - RNA, 1969 nt, Artificial Sequence
  PpLuc variant
gggagaguccgcucagccagguugcagaagcggcuuagcguguguccuaaucuucucucugcguguagguaggccugugccgcaaacaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 207 - RNA, 2037 nt, Artificial Sequence
  HRSV variant
gggagaguccgcucagccagguugcagaagcggcuuagcguguguccuaaucuucucucugcguguagguaggccugugccgcaaacaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 208 - RNA, 2166 nt, Artificial Sequence
  RAV-G variant
gggagaguccgcucagccagguugcagaagcggcuuagcguguguccuaaucuucucucugcguguagguaggccugugccgcaaacaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 209 - RNA, 2107 nt, Artificial Sequence
  RAV-G variant
gggagaguccgcucagccagguugcagaagcggcuuagcguguguccuaaucuucucucugcguguagguaggccugugccgcaaacaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 210 - RNA, 1173 nt, Artificial Sequence
  HsEPO variant
gggagaguccgcucagccagguugcagaagcggcuuagcguguguccuaaucuucucucugcguguagguaggccugugccgcaaacaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 211 - RNA, 1114 nt, Artificial Sequence
  HsEPO variant
gggagaguccgcucagccagguugcagaagcggcuuagcguguguccuaaucuucucucugcguguagguaggccugugccgcaaacaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 212 - RNA, 2244 nt, Artificial Sequence
  PpLuc variant
gggagaguccgcucagccagguugcagaagcggcuuagcguguguccuaaucuucucucugcguguagguaggccugugccgcaaacaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 213 - RNA, 2185 nt, Artificial Sequence
  PpLuc variant
gggagaguccgcucagccagguugcagaagcggcuuagcguguguccuaaucuucucucugcguguagguaggccugugccgcaaacaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 214 - RNA, 2253 nt, Artificial Sequence
  HRSV variant
gggagaguccgcucagccagguugcagaagcggcuuagcguguguccuaaucuucucucugcguguagguaggccugugccgcaaacaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 215 - RNA, 1946 nt, Artificial Sequence
  RAV-G variant
gggagaguccgcucagccagguugcagaagcggcuuagcguguguccuaaucuucucucugcguguagguaggccugugccgcaaacaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 216 - RNA, 1887 nt, Artificial Sequence
  RAV-G variant
gggagaguccgcucagccagguugcagaagcggcuuagcguguguccuaaucuucucucugcguguagguaggccugugccgcaaacaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 217 - RNA, 953 nt, Artificial Sequence
  HsEPO variant
gggagaguccgcucagccagguugcagaagcggcuuagcguguguccuaaucuucucucugcguguagguaggccugugccgcaaacaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 218 - RNA, 894 nt, Artificial Sequence
  HsEPO variant
gggagaguccgcucagccagguugcagaagcggcuuagcguguguccuaaucuucucucugcguguagguaggccugugccgcaaacaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 219 - RNA, 2024 nt, Artificial Sequence
  PpLuc variant
gggagaguccgcucagccagguugcagaagcggcuuagcguguguccuaaucuucucucugcguguagguaggccugugccgcaaacaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 220 - RNA, 1965 nt, Artificial Sequence
  PpLuc variant
gggagaguccgcucagccagguugcagaagcggcuuagcguguguccuaaucuucucucugcguguagguaggccugugccgcaaacaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 221 - RNA, 2033 nt, Artificial Sequence
  HRSV variant
gggagaguccgcucagccagguugcagaagcggcuuagcguguguccuaaucuucucucugcguguagguaggccugugccgcaaacaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 222 - RNA, 1883 nt, Artificial Sequence
  RAV-G variant
gggagaguccgcucagccagguugcagaagcggcuuagcguguguccuaaucuucucucugcguguagguaggccugugccgcaaacaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 223 - RNA, 1824 nt, Artificial Sequence
  RAV-G variant
gggagaguccgcucagccagguugcagaagcggcuuagcguguguccuaaucuucucucugcguguagguaggccugugccgcaaacaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 224 - RNA, 890 nt, Artificial Sequence
  HsEPO variant
gggagaguccgcucagccagguugcagaagcggcuuagcguguguccuaaucuucucucugcguguagguaggccugugccgcaaacaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 225 - RNA, 831 nt, Artificial Sequence
  HsEPO variant
gggagaguccgcucagccagguugcagaagcggcuuagcguguguccuaaucuucucucugcguguagguaggccugugccgcaaacaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 226 - RNA, 1961 nt, Artificial Sequence
  PpLuc variant
gggagaguccgcucagccagguugcagaagcggcuuagcguguguccuaaucuucucucugcguguagguaggccugugccgcaaacaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 227 - RNA, 1902 nt, Artificial Sequence
  PpLuc variant
gggagaguccgcucagccagguugcagaagcggcuuagcguguguccuaaucuucucucugcguguagguaggccugugccgcaaacaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 228 - RNA, 1970 nt, Artificial Sequence
  HRSV variant
gggagaguccgcucagccagguugcagaagcggcuuagcguguguccuaaucuucucucugcguguagguaggccugugccgcaaacaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 229 - RNA, 1897 nt, Artificial Sequence
  RAV-G variant
gggagacuccugucgggcggaaguaggaggaguagaguuuaaaaacaguacucuuuuuccgguucgggacguaguugaagcaacgacaagccggauaaccgcucuugagacaggaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 230 - RNA, 1838 nt, Artificial Sequence
  RAV-G variant
gggagacuccugucgggcggaaguaggaggaguagaguuuaaaaacaguacucuuuuuccgguucgggacguaguugaagcaacgacaagccggauaaccgcucuugagacaggaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 231 - RNA, 904 nt, Artificial Sequence
  HsEPO variant
gggagacuccugucgggcggaaguaggaggaguagaguuuaaaaacaguacucuuuuuccgguucgggacguaguugaagcaacgacaagccggauaaccgcucuugagacaggaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 232 - RNA, 845 nt, Artificial Sequence
  HsEPO variant
gggagacuccugucgggcggaaguaggaggaguagaguuuaaaaacaguacucuuuuuccgguucgggacguaguugaagcaacgacaagccggauaaccgcucuugagacaggaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 233 - RNA, 1975 nt, Artificial Sequence
  PpLuc variant
gggagacuccugucgggcggaaguaggaggaguagaguuuaaaaacaguacucuuuuuccgguucgggacguaguugaagcaacgacaagccggauaaccgcucuugagacaggaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 234 - RNA, 1916 nt, Artificial Sequence
  PpLuc variant
gggagacuccugucgggcggaaguaggaggaguagaguuuaaaaacaguacucuuuuuccgguucgggacguaguugaagcaacgacaagccggauaaccgcucuugagacaggaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 235 - RNA, 1984 nt, Artificial Sequence
  HRSV variant
gggagacuccugucgggcggaaguaggaggaguagaguuuaaaaacaguacucuuuuuccgguucgggacguaguugaagcaacgacaagccggauaaccgcucuugagacaggaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 236 - RNA, 1961 nt, Artificial Sequence
  RAV-G variant
gggagacuccugucgggcggaaguaggaggaguagaguuuaaaaacaguacucuuuuuccgguucgggacguaguugaagcaacgacaagccggauaaccgcucuugagacaggaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 237 - RNA, 1902 nt, Artificial Sequence
  RAV-G variant
gggagacuccugucgggcggaaguaggaggaguagaguuuaaaaacaguacucuuuuuccgguucgggacguaguugaagcaacgacaagccggauaaccgcucuugagacaggaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 238 - RNA, 968 nt, Artificial Sequence
  HsEPO variant
gggagacuccugucgggcggaaguaggaggaguagaguuuaaaaacaguacucuuuuuccgguucgggacguaguugaagcaacgacaagccggauaaccgcucuugagacaggaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 239 - RNA, 909 nt, Artificial Sequence
  HsEPO variant
gggagacuccugucgggcggaaguaggaggaguagaguuuaaaaacaguacucuuuuuccgguucgggacguaguugaagcaacgacaagccggauaaccgcucuugagacaggaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 240 - RNA, 2039 nt, Artificial Sequence
  PpLuc variant
gggagacuccugucgggcggaaguaggaggaguagaguuuaaaaacaguacucuuuuuccgguucgggacguaguugaagcaacgacaagccggauaaccgcucuugagacaggaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 241 - RNA, 1980 nt, Artificial Sequence
  PpLuc variant
gggagacuccugucgggcggaaguaggaggaguagaguuuaaaaacaguacucuuuuuccgguucgggacguaguugaagcaacgacaagccggauaaccgcucuugagacaggaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 242 - RNA, 2048 nt, Artificial Sequence
  HRSV variant
gggagacuccugucgggcggaaguaggaggaguagaguuuaaaaacaguacucuuuuuccgguucgggacguaguugaagcaacgacaagccggauaaccgcucuugagacaggaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 243 - RNA, 1977 nt, Artificial Sequence
  RAV-G variant
gggagacuccugucgggcggaaguaggaggaguagaguuuaaaaacaguacucuuuuuccgguucgggacguaguugaagcaacgacaagccggauaaccgcucuugagacaggaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 244 - RNA, 1918 nt, Artificial Sequence
  RAV-G variant
gggagacuccugucgggcggaaguaggaggaguagaguuuaaaaacaguacucuuuuuccgguucgggacguaguugaagcaacgacaagccggauaaccgcucuugagacaggaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 245 - RNA, 984 nt, Artificial Sequence
  HsEPO variant
gggagacuccugucgggcggaaguaggaggaguagaguuuaaaaacaguacucuuuuuccgguucgggacguaguugaagcaacgacaagccggauaaccgcucuugagacaggaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 246 - RNA, 925 nt, Artificial Sequence
  HsEPO variant
gggagacuccugucgggcggaaguaggaggaguagaguuuaaaaacaguacucuuuuuccgguucgggacguaguugaagcaacgacaagccggauaaccgcucuugagacaggaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 247 - RNA, 2055 nt, Artificial Sequence
  PpLuc variant
gggagacuccugucgggcggaaguaggaggaguagaguuuaaaaacaguacucuuuuuccgguucgggacguaguugaagcaacgacaagccggauaaccgcucuugagacaggaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 248 - RNA, 1996 nt, Artificial Sequence
  PpLuc variant
gggagacuccugucgggcggaaguaggaggaguagaguuuaaaaacaguacucuuuuuccgguucgggacguaguugaagcaacgacaagccggauaaccgcucuugagacaggaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 249 - RNA, 2064 nt, Artificial Sequence
  HRSV variant
gggagacuccugucgggcggaaguaggaggaguagaguuuaaaaacaguacucuuuuuccgguucgggacguaguugaagcaacgacaagccggauaaccgcucuugagacaggaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 250 - RNA, 2193 nt, Artificial Sequence
  RAV-G variant
gggagacuccugucgggcggaaguaggaggaguagaguuuaaaaacaguacucuuuuuccgguucgggacguaguugaagcaacgacaagccggauaaccgcucuugagacaggaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 251 - RNA, 2134 nt, Artificial Sequence
  RAV-G variant
gggagacuccugucgggcggaaguaggaggaguagaguuuaaaaacaguacucuuuuuccgguucgggacguaguugaagcaacgacaagccggauaaccgcucuugagacaggaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 252 - RNA, 1200 nt, Artificial Sequence
  HsEPO variant
gggagacuccugucgggcggaaguaggaggaguagaguuuaaaaacaguacucuuuuuccgguucgggacguaguugaagcaacgacaagccggauaaccgcucuugagacaggaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 253 - RNA, 1141 nt, Artificial Sequence
  HsEPO variant
gggagacuccugucgggcggaaguaggaggaguagaguuuaaaaacaguacucuuuuuccgguucgggacguaguugaagcaacgacaagccggauaaccgcucuugagacaggaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 254 - RNA, 2271 nt, Artificial Sequence
  PpLuc variant
gggagacuccugucgggcggaaguaggaggaguagaguuuaaaaacaguacucuuuuuccgguucgggacguaguugaagcaacgacaagccggauaaccgcucuugagacaggaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 255 - RNA, 2212 nt, Artificial Sequence
  PpLuc variant
gggagacuccugucgggcggaaguaggaggaguagaguuuaaaaacaguacucuuuuuccgguucgggacguaguugaagcaacgacaagccggauaaccgcucuugagacaggaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 256 - RNA, 2280 nt, Artificial Sequence
  HRSV variant
gggagacuccugucgggcggaaguaggaggaguagaguuuaaaaacaguacucuuuuuccgguucgggacguaguugaagcaacgacaagccggauaaccgcucuugagacaggaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 257 - RNA, 1973 nt, Artificial Sequence
  RAV-G variant
gggagacuccugucgggcggaaguaggaggaguagaguuuaaaaacaguacucuuuuuccgguucgggacguaguugaagcaacgacaagccggauaaccgcucuugagacaggaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 258 - RNA, 1914 nt, Artificial Sequence
  RAV-G variant
gggagacuccugucgggcggaaguaggaggaguagaguuuaaaaacaguacucuuuuuccgguucgggacguaguugaagcaacgacaagccggauaaccgcucuugagacaggaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 259 - RNA, 980 nt, Artificial Sequence
  HsEPO variant
gggagacuccugucgggcggaaguaggaggaguagaguuuaaaaacaguacucuuuuuccgguucgggacguaguugaagcaacgacaagccggauaaccgcucuugagacaggaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 260 - RNA, 921 nt, Artificial Sequence
  HsEPO variant
gggagacuccugucgggcggaaguaggaggaguagaguuuaaaaacaguacucuuuuuccgguucgggacguaguugaagcaacgacaagccggauaaccgcucuugagacaggaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 261 - RNA, 2051 nt, Artificial Sequence
  PpLuc variant
gggagacuccugucgggcggaaguaggaggaguagaguuuaaaaacaguacucuuuuuccgguucgggacguaguugaagcaacgacaagccggauaaccgcucuugagacaggaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 262 - RNA, 1992 nt, Artificial Sequence
  PpLuc variant
gggagacuccugucgggcggaaguaggaggaguagaguuuaaaaacaguacucuuuuuccgguucgggacguaguugaagcaacgacaagccggauaaccgcucuugagacaggaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 263 - RNA, 2060 nt, Artificial Sequence
  HRSV variant
gggagacuccugucgggcggaaguaggaggaguagaguuuaaaaacaguacucuuuuuccgguucgggacguaguugaagcaacgacaagccggauaaccgcucuugagacaggaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 264 - RNA, 1910 nt, Artificial Sequence
  RAV-G variant
gggagacuccugucgggcggaaguaggaggaguagaguuuaaaaacaguacucuuuuuccgguucgggacguaguugaagcaacgacaagccggauaaccgcucuugagacaggaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 265 - RNA, 1851 nt, Artificial Sequence
  RAV-G variant
gggagacuccugucgggcggaaguaggaggaguagaguuuaaaaacaguacucuuuuuccgguucgggacguaguugaagcaacgacaagccggauaaccgcucuugagacaggaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 266 - RNA, 917 nt, Artificial Sequence
  HsEPO variant
gggagacuccugucgggcggaaguaggaggaguagaguuuaaaaacaguacucuuuuuccgguucgggacguaguugaagcaacgacaagccggauaaccgcucuugagacaggaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 267 - RNA, 858 nt, Artificial Sequence
  HsEPO variant
gggagacuccugucgggcggaaguaggaggaguagaguuuaaaaacaguacucuuuuuccgguucgggacguaguugaagcaacgacaagccggauaaccgcucuugagacaggaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 268 - RNA, 1988 nt, Artificial Sequence
  PpLuc variant
gggagacuccugucgggcggaaguaggaggaguagaguuuaaaaacaguacucuuuuuccgguucgggacguaguugaagcaacgacaagccggauaaccgcucuugagacaggaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 269 - RNA, 1929 nt, Artificial Sequence
  PpLuc variant
gggagacuccugucgggcggaaguaggaggaguagaguuuaaaaacaguacucuuuuuccgguucgggacguaguugaagcaacgacaagccggauaaccgcucuugagacaggaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 270 - RNA, 1997 nt, Artificial Sequence
  HRSV variant
gggagacuccugucgggcggaaguaggaggaguagaguuuaaaaacaguacucuuuuuccgguucgggacguaguugaagcaacgacaagccggauaaccgcucuugagacaggaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 271 - RNA, 1873 nt, Artificial Sequence
  RAV-G variant
gggagacccgugacccggaaguuguacggcuacgcgacuuucccucccacaaacccucgcgcccuuccuuuccuacuugggcccggcagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 272 - RNA, 1814 nt, Artificial Sequence
  RAV-G variant
gggagacccgugacccggaaguuguacggcuacgcgacuuucccucccacaaacccucgcgcccuuccuuuccuacuugggcccggcagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 273 - RNA, 880 nt, Artificial Sequence
  HsEPO variant
gggagacccgugacccggaaguuguacggcuacgcgacuuucccucccacaaacccucgcgcccuuccuuuccuacuugggcccggcagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 274 - RNA, 821 nt, Artificial Sequence
  HsEPO variant
gggagacccgugacccggaaguuguacggcuacgcgacuuucccucccacaaacccucgcgcccuuccuuuccuacuugggcccggcagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 275 - RNA, 1951 nt, Artificial Sequence
  PpLuc variant
gggagacccgugacccggaaguuguacggcuacgcgacuuucccucccacaaacccucgcgcccuuccuuuccuacuugggcccggcagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 276 - RNA, 1892 nt, Artificial Sequence
  PpLuc variant
gggagacccgugacccggaaguuguacggcuacgcgacuuucccucccacaaacccucgcgcccuuccuuuccuacuugggcccggcagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 277 - RNA, 1960 nt, Artificial Sequence
  HRSV variant
gggagacccgugacccggaaguuguacggcuacgcgacuuucccucccacaaacccucgcgcccuuccuuuccuacuugggcccggcagaaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 278 - RNA, 1937 nt, Artificial Sequence
  RAV-G variant
gggagacccgugacccggaaguuguacggcuacgcgacuuucccucccacaaacccucgcgcccuuccuuuccuacuugggcccggcagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 279 - RNA, 1878 nt, Artificial Sequence
  RAV-G variant
gggagacccgugacccggaaguuguacggcuacgcgacuuucccucccacaaacccucgcgcccuuccuuuccuacuugggcccggcagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 280 - RNA, 944 nt, Artificial Sequence
  HsEPO variant
gggagacccgugacccggaaguuguacggcuacgcgacuuucccucccacaaacccucgcgcccuuccuuuccuacuugggcccggcagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 281 - RNA, 885 nt, Artificial Sequence
  HsEPO variant
gggagacccgugacccggaaguuguacggcuacgcgacuuucccucccacaaacccucgcgcccuuccuuuccuacuugggcccggcagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 282 - RNA, 2015 nt, Artificial Sequence
  PpLuc variant
gggagacccgugacccggaaguuguacggcuacgcgacuuucccucccacaaacccucgcgcccuuccuuuccuacuugggcccggcagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 283 - RNA, 1956 nt, Artificial Sequence
  PpLuc variant
gggagacccgugacccggaaguuguacggcuacgcgacuuucccucccacaaacccucgcgcccuuccuuuccuacuugggcccggcagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 284 - RNA, 2024 nt, Artificial Sequence
  HRSV variant
gggagacccgugacccggaaguuguacggcuacgcgacuuucccucccacaaacccucgcgcccuuccuuuccuacuugggcccggcagaaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 285 - RNA, 1953 nt, Artificial Sequence
  RAV-G variant
gggagacccgugacccggaaguuguacggcuacgcgacuuucccucccacaaacccucgcgcccuuccuuuccuacuugggcccggcagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 286 - RNA, 1894 nt, Artificial Sequence
  RAV-G variant
gggagacccgugacccggaaguuguacggcuacgcgacuuucccucccacaaacccucgcgcccuuccuuuccuacuugggcccggcagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 287 - RNA, 960 nt, Artificial Sequence
  HsEPO variant
gggagacccgugacccggaaguuguacggcuacgcgacuuucccucccacaaacccucgcgcccuuccuuuccuacuugggcccggcagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 288 - RNA, 901 nt, Artificial Sequence
  HsEPO variant
gggagacccgugacccggaaguuguacggcuacgcgacuuucccucccacaaacccucgcgcccuuccuuuccuacuugggcccggcagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 289 - RNA, 2031 nt, Artificial Sequence
  PpLuc variant
gggagacccgugacccggaaguuguacggcuacgcgacuuucccucccacaaacccucgcgcccuuccuuuccuacuugggcccggcagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 290 - RNA, 1972 nt, Artificial Sequence
  PpLuc variant
gggagacccgugacccggaaguuguacggcuacgcgacuuucccucccacaaacccucgcgcccuuccuuuccuacuugggcccggcagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 291 - RNA, 2040 nt, Artificial Sequence
  HRSV variant
gggagacccgugacccggaaguuguacggcuacgcgacuuucccucccacaaacccucgcgcccuuccuuuccuacuugggcccggcagaaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 292 - RNA, 2169 nt, Artificial Sequence
  RAV-G variant
gggagacccgugacccggaaguuguacggcuacgcgacuuucccucccacaaacccucgcgcccuuccuuuccuacuugggcccggcagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 293 - RNA, 2110 nt, Artificial Sequence
  RAV-G variant
gggagacccgugacccggaaguuguacggcuacgcgacuuucccucccacaaacccucgcgcccuuccuuuccuacuugggcccggcagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 294 - RNA, 1176 nt, Artificial Sequence
  HsEPO variant
gggagacccgugacccggaaguuguacggcuacgcgacuuucccucccacaaacccucgcgcccuuccuuuccuacuugggcccggcagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 295 - RNA, 1117 nt, Artificial Sequence
  HsEPO variant
gggagacccgugacccggaaguuguacggcuacgcgacuuucccucccacaaacccucgcgcccuuccuuuccuacuugggcccggcagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 296 - RNA, 2247 nt, Artificial Sequence
  PpLuc variant
gggagacccgugacccggaaguuguacggcuacgcgacuuucccucccacaaacccucgcgcccuuccuuuccuacuugggcccggcagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 297 - RNA, 2188 nt, Artificial Sequence
  PpLuc variant
gggagacccgugacccggaaguuguacggcuacgcgacuuucccucccacaaacccucgcgcccuuccuuuccuacuugggcccggcagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 298 - RNA, 2256 nt, Artificial Sequence
  HRSV variant
gggagacccgugacccggaaguuguacggcuacgcgacuuucccucccacaaacccucgcgcccuuccuuuccuacuugggcccggcagaaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 299 - RNA, 1949 nt, Artificial Sequence
  RAV-G variant
gggagacccgugacccggaaguuguacggcuacgcgacuuucccucccacaaacccucgcgcccuuccuuuccuacuugggcccggcagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 300 - RNA, 1890 nt, Artificial Sequence
  RAV-G variant
gggagacccgugacccggaaguuguacggcuacgcgacuuucccucccacaaacccucgcgcccuuccuuuccuacuugggcccggcagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 301 - RNA, 956 nt, Artificial Sequence
  HsEPO variant
gggagacccgugacccggaaguuguacggcuacgcgacuuucccucccacaaacccucgcgcccuuccuuuccuacuugggcccggcagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 302 - RNA, 897 nt, Artificial Sequence
  HsEPO variant
gggagacccgugacccggaaguuguacggcuacgcgacuuucccucccacaaacccucgcgcccuuccuuuccuacuugggcccggcagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 303 - RNA, 2027 nt, Artificial Sequence
  PpLuc variant
gggagacccgugacccggaaguuguacggcuacgcgacuuucccucccacaaacccucgcgcccuuccuuuccuacuugggcccggcagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 304 - RNA, 1968 nt, Artificial Sequence
  PpLuc variant
gggagacccgugacccggaaguuguacggcuacgcgacuuucccucccacaaacccucgcgcccuuccuuuccuacuugggcccggcagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 305 - RNA, 2036 nt, Artificial Sequence
  HRSV variant
gggagacccgugacccggaaguuguacggcuacgcgacuuucccucccacaaacccucgcgcccuuccuuuccuacuugggcccggcagaaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 306 - RNA, 1886 nt, Artificial Sequence
  RAV-G variant
gggagacccgugacccggaaguuguacggcuacgcgacuuucccucccacaaacccucgcgcccuuccuuuccuacuugggcccggcagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 307 - RNA, 1827 nt, Artificial Sequence
  RAV-G variant
gggagacccgugacccggaaguuguacggcuacgcgacuuucccucccacaaacccucgcgcccuuccuuuccuacuugggcccggcagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 308 - RNA, 893 nt, Artificial Sequence
  HsEPO variant
gggagacccgugacccggaaguuguacggcuacgcgacuuucccucccacaaacccucgcgcccuuccuuuccuacuugggcccggcagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 309 - RNA, 834 nt, Artificial Sequence
  HsEPO variant
gggagacccgugacccggaaguuguacggcuacgcgacuuucccucccacaaacccucgcgcccuuccuuuccuacuugggcccggcagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 310 - RNA, 1964 nt, Artificial Sequence
  PpLuc variant
gggagacccgugacccggaaguuguacggcuacgcgacuuucccucccacaaacccucgcgcccuuccuuuccuacuugggcccggcagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 311 - RNA, 1905 nt, Artificial Sequence
  PpLuc variant
gggagacccgugacccggaaguuguacggcuacgcgacuuucccucccacaaacccucgcgcccuuccuuuccuacuugggcccggcagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 312 - RNA, 1973 nt, Artificial Sequence
  HRSV variant
gggagacccgugacccggaaguuguacggcuacgcgacuuucccucccacaaacccucgcgcccuuccuuuccuacuugggcccggcagaaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 313 - RNA, 1948 nt, Artificial Sequence
  RAV-G variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 314 - RNA, 1889 nt, Artificial Sequence
  RAV-G variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 315 - RNA, 955 nt, Artificial Sequence
  HsEPO variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 316 - RNA, 896 nt, Artificial Sequence
  HsEPO variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 317 - RNA, 2026 nt, Artificial Sequence
  PpLuc variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 318 - RNA, 1967 nt, Artificial Sequence
  PpLuc variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 319 - RNA, 2035 nt, Artificial Sequence
  HRSV variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 320 - RNA, 2012 nt, Artificial Sequence
  RAV-G variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 321 - RNA, 1953 nt, Artificial Sequence
  RAV-G variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 322 - RNA, 1019 nt, Artificial Sequence
  HsEPO variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 323 - RNA, 960 nt, Artificial Sequence
  HsEPO variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 324 - RNA, 2090 nt, Artificial Sequence
  PpLuc variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 325 - RNA, 2031 nt, Artificial Sequence
  PpLuc variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 326 - RNA, 2099 nt, Artificial Sequence
  HRSV variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 327 - RNA, 2028 nt, Artificial Sequence
  RAV-G variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 328 - RNA, 1969 nt, Artificial Sequence
  RAV-G variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 329 - RNA, 1035 nt, Artificial Sequence
  HsEPO variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 330 - RNA, 976 nt, Artificial Sequence
  HsEPO variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 331 - RNA, 2106 nt, Artificial Sequence
  PpLuc variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 332 - RNA, 2047 nt, Artificial Sequence
  PpLuc variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaagaauu

SEQ ID NO: 333 - RNA, 2115 nt, Artificial Sequence
  HRSV variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguacuggcugcaucucccuuuccucuguccuccauccuucucccaggauggugaagggggaccugguacccagugauccccaccccaggauccuaaaucaugacuuaccugcuaauaaaaacucauuggaaaagugagaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 334 - RNA, 2244 nt, Artificial Sequence
  RAV-G variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 335 - RNA, 2185 nt, Artificial Sequence
  RAV-G variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 336 - RNA, 1251 nt, Artificial Sequence
  HsEPO variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 337 - RNA, 1192 nt, Artificial Sequence
  HsEPO variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 338 - RNA, 2322 nt, Artificial Sequence
  PpLuc variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 339 - RNA, 2263 nt, Artificial Sequence
  PpLuc variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 340 - RNA, 2331 nt, Artificial Sequence
  HRSV variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 341 - RNA, 2024 nt, Artificial Sequence
  RAV-G variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 342 - RNA, 1965 nt, Artificial Sequence
  RAV-G variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 343 - RNA, 1031 nt, Artificial Sequence
  HsEPO variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 344 - RNA, 972 nt, Artificial Sequence
  HsEPO variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 345 - RNA, 2102 nt, Artificial Sequence
  PpLuc variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 346 - RNA, 2043 nt, Artificial Sequence
  PpLuc variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaagaauu

SEQ ID NO: 347 - RNA, 2111 nt, Artificial Sequence
  HRSV variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 348 - RNA, 1961 nt, Artificial Sequence
  RAV-G variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 349 - RNA, 1902 nt, Artificial Sequence
  RAV-G variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 350 - RNA, 968 nt, Artificial Sequence
  HsEPO variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 351 - RNA, 909 nt, Artificial Sequence
  HsEPO variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 352 - RNA, 2039 nt, Artificial Sequence
  PpLuc variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 353 - RNA, 1980 nt, Artificial Sequence
  PpLuc variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 354 - RNA, 2048 nt, Artificial Sequence
  HRSV variant
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 355 - RNA, 1904 nt, Artificial Sequence
  RAV-G variant
gggagaauauaagcguuggcggagcgucgguuguagcacucugcgcgcccgcucuucugcugcuguuugucuacuuccuccugcuuccccgccgccgccgccgccaucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 356 - RNA, 1845 nt, Artificial Sequence
  RAV-G variant
gggagaauauaagcguuggcggagcgucgguuguagcacucugcgcgcccgcucuucugcugcuguuugucuacuuccuccugcuuccccgccgccgccgccgccaucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 357 - RNA, 911 nt, Artificial Sequence
  HsEPO variant
gggagaauauaagcguuggcggagcgucgguuguagcacucugcgcgcccgcucuucugcugcuguuugucuacuuccuccugcuuccccgccgccgccgccgccaucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 358 - RNA, 852 nt, Artificial Sequence
  HsEPO variant
gggagaauauaagcguuggcggagcgucgguuguagcacucugcgcgcccgcucuucugcugcuguuugucuacuuccuccugcuuccccgccgccgccgccgccaucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 359 - RNA, 1982 nt, Artificial Sequence
  PpLuc variant
gggagaauauaagcguuggcggagcgucgguuguagcacucugcgcgcccgcucuucugcugcuguuugucuacuuccuccugcuuccccgccgccgccgccgccaucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 360 - RNA, 1923 nt, Artificial Sequence
  PpLuc variant
gggagaauauaagcguuggcggagcgucgguuguagcacucugcgcgcccgcucuucugcugcuguuugucuacuuccuccugcuuccccgccgccgccgccgccaucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 361 - RNA, 1991 nt, Artificial Sequence
  HRSV variant
gggagaauauaagcguuggcggagcgucgguuguagcacucugcgcgcccgcucuucugcugcuguuugucuacuuccuccugcuuccccgccgccgccgccgccaucaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 362 - RNA, 2024 nt, Artificial Sequence
  RAV-G variant
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 363 - RNA, 1965 nt, Artificial Sequence
  RAV-G variant
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 364 - RNA, 1031 nt, Artificial Sequence
  HsEPO variant
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 365 - RNA, 972 nt, Artificial Sequence
  HsEPO variant
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 366 - RNA, 2102 nt, Artificial Sequence
  PpLuc variant
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 367 - RNA, 2043 nt, Artificial Sequence
  PpLuc variant
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 368 - RNA, 2111 nt, Artificial Sequence
  HRSV variant
gggagacggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 369 - RNA, 1957 nt, Artificial Sequence
  RAV-G variant
ggggcgcugccuacggagguggcagccaucuccuucucggcaucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 370 - RNA, 1961 nt, Artificial Sequence
  RAV-G variant
gggagaggcgcugccuacggagguggcagccaucuccuucucggcaucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 371 - RNA, 1898 nt, Artificial Sequence
  RAV-G variant
ggggcgcugccuacggagguggcagccaucuccuucucggcaucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 372 - RNA, 1902 nt, Artificial Sequence
  RAV-G variant
gggagaggcgcugccuacggagguggcagccaucuccuucucggcaucaagcuuaccauggugccccaggcccuccuguucgucccgcugcugguguucccccucugcuucggcaaguuccccaucuacaccauccccgacaagcuggggccguggagccccaucgacauccaccaccuguccugccccaacaaccucguggucgaggacgagggcugcaccaaccugagcggguucuccuacauggagcugaaggugggcuacaucagcgccaucaagaugaacggguucacgugcaccggcguggucaccgaggcggagaccuacacgaacuucgugggcuacgugaccaccaccuucaagcggaagcacuuccgccccacgccggacgccugccgggccgccuacaacuggaagauggccggggacccccgcuacgaggagucccuccacaaccccuaccccgacuaccacuggcugcggaccgucaagaccaccaaggagagccuggugaucaucuccccgagcguggcggaccucgaccccuacgaccgcucccugcacagccgggucuuccccggcgggaacugcuccggcguggccgugagcuccacguacugcagcaccaaccacgacuacaccaucuggaugcccgagaacccgcgccuggggauguccugcgacaucuucaccaacagccggggcaagcgcgccuccaagggcagcgagacgugcggguucgucgacgagcggggccucuacaagucccugaagggggccugcaagcugaagcucugcggcgugcugggccugcgccucauggacgggaccuggguggcgaugcagaccagcaacgagaccaaguggugcccccccggccagcuggucaaccugcacgacuuccggagcgacgagaucgagcaccucgugguggaggagcuggucaagaagcgcgaggagugccuggacgcccucgaguccaucaugacgaccaagagcguguccuuccggcgccugagccaccuccggaagcuggugcccggguucggcaaggccuacaccaucuucaacaagacccugauggaggccgacgcccacuacaaguccguccgcacguggaacgagaucaucccgagcaaggggugccugcgggugggcggccgcugccacccccacgucaacgggguguucuucaacggcaucauccucgggcccgacggcaacgugcugauccccgagaugcaguccagccugcuccagcagcacauggagcugcuggucuccagcgugaucccgcucaugcacccccuggcggaccccuccaccguguucaagaacggggacgaggccgaggacuucgucgaggugcaccuccccgacgugcacgagcggaucagcggcgucgaccugggccugccgaacugggggaaguacgugcugcucuccgccggcgcccugaccgcccugaugcugaucaucuuccucaugaccugcuggcgccgggugaaccggagcgagcccacgcagcacaaccugcgcgggaccggccgggaggucuccgugaccccgcagagcgggaagaucaucuccagcugggaguccuacaagagcggcggcgagaccgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 373 - RNA, 968 nt, Artificial Sequence
  HsEPO variant
gggagaggcgcugccuacggagguggcagccaucuccuucucggcaucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 374 - RNA, 909 nt, Artificial Sequence
  HsEPO variant
gggagaggcgcugccuacggagguggcagccaucuccuucucggcaucaagcuuaccaugggcgugcacgagugccccgccuggcuguggcuccugcugagccuccugucccugccgcucgggcugcccguccugggcgcccccccgcggcucaucugcgacagccgcgugcuggagcgguaccugcucgaggcgaaggaggccgagaacaucaccaccgggugcgccgagcacugcucccugaacgagaacaucacggugccggacaccaaggucaacuucuacgccuggaagcgcauggaggugggccagcaggccguggaggucuggcaggggcuggcgcuccugagcgaggccgugcugcggggccaggcccuccuggugaacuccagccagcccugggagccccugcagcuccacgucgacaaggccguguccggccugcgcagccugaccacccuccugcgggcgcugggggcccagaaggaggccaucucccccccggacgccgccagcgcggccccgcuccgcacgaucaccgccgacaccuuccggaagcuguuccgcguguacuccaacuuccugcggggcaagcucaagcuguacaccggggaggccugccgcacgggcgaccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 375 - RNA, 2039 nt, Artificial Sequence
  PpLuc variant
gggagaggcgcugccuacggagguggcagccaucuccuucucggcaucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 376 - RNA, 1980 nt, Artificial Sequence
  PpLuc variant
gggagaggcgcugccuacggagguggcagccaucuccuucucggcaucaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 377 - RNA, 2048 nt, Artificial Sequence
  HRSV variant
gggagaggcgcugccuacggagguggcagccaucuccuucucggcaucaagcuuaccauggagcugcucauccugaaggccaacgccaucaccaccauccugacggcggugaccuucugcuucgccagcggccagaacaucaccgaggaguucuaccaguccacgugcagcgccgucuccaagggguaccucagcgcccugcggaccggcugguacaccuccgugaucaccaucgagcugagcaacaucaaggagaacaagugcaacgggaccgacgccaaggugaagcucaucaagcaggagcuggacaaguacaagaacgcggucacggagcugcagcuccugaugcaguccaccccggcaaccaacaaccgcgcccggcgcgagcugccccgguucaugaacuacacccucaacaacgccaagaagacgaacgugacccugagcaagaagcgcaagcggcgcuuccugggcuuccuccugggggugggcuccgccaucgcgagcggcgucgccgugugcaaggugcugcaccucgagggggaggucaacaagaucaagagcgcccugcuguccaccaacaaggccguggugagccucuccaacggcgucagcgugcugaccuucaaggugcuggaccucaagaacuacaucgacaagcagcugcugcccauccugaacaagcagagcugcuccaucagcaacaucgagacggugaucgaguuccagcagaagaacaaccggcuccuggagaucacccgcgaguucagcgugaacgccggggucaccacccccguguccacguacaugcugaccaacagcgagcuccugucccugaucaacgacaugccgaucaccaacgaccagaagaagcucaugagcaacaacgugcagaucguccggcagcaguccuacagcaucaugugcaucaucaaggaggaggugcuggcguacgugguccagcugccccucuacggcgugaucgacacccccugcuggaagcugcacacgagcccccugugcaccaccaacaccaaggagggguccaacaucugccucacgcgcaccgaccggggcugguacugcgacaacgccggcagcgucuccuucuucccgcaggccgagaccugcaaggugcagagcaaccgcguguucugcgacaccaugaacucccugacgcugcccagcgagguaaaccucugcaacgucgacaucuucaaccccaaguacgacugcaagaucaugaccuccaagaccgacgugagcuccagcgugaucaccucccugggggccaucgucagcugcuacggcaagacgaagugcaccgccagcaacaagaaccgggggaucaucaagaccuucuccaacggcugcgacuacgugagcaacaagggcguggacaccguguccgucgggaacacccuguacuacgugaacaagcaggagggcaagagccucuacgugaagggggagcccaucaucaacuucuacgacccgcuggucuuccccuccgacgaguucgacgcgagcaucucccaggugaacgagaagaucaaccagagccuggccuucauccgcaaguccgacgagcugcuccacaacgugaacgccggcaagagcacgaccaacaucaugaucaccaccaucaucaucgucaucaucgugauccugcugucccucaucgccguggggcugcugcucuacugcaaggcccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 378 - protein, 8 aa, Artificial Sequence
  peptide tag
DYKDDDDK

SEQ ID NO: 379 - protein, 10 aa, Artificial Sequence
  peptide tag
EQKLISEEDL

SEQ ID NO: 380 - protein, 9 aa, Artificial Sequence
  peptide tag
YPYDVPDYA

SEQ ID NO: 381 - protein, 7 aa, Artificial Sequence
  NLS
PKKKRRV

SEQ ID NO: 382 - protein, 16 aa, Artificial Sequence
  NLS
KRPAATKKAGQAKKKK

SEQ ID NO: 383 - protein, 5 aa, Artificial Sequence
  Linker
GGGGS

SEQ ID NO: 384 - protein, 4 aa, Artificial Sequence
  NLS
  VARIANT (2)..(2): Xaa can be amino acid Arg or Lys
  VARIANT (3)..(3): Xaa can be any naturally occurring amino acid
  VARIANT (4)..(4): Xaa can be amino acid Arg or Lys
KXXX

SEQ ID NO: 385 - DNA, 62 bp, Artificial Sequence; identical to SEQ ID NO: 1
  5'-UTR_HSD17B4

SEQ ID NO: 386 - RNA, 62 nt, Artificial Sequence; identical to SEQ ID NO: 2
  5'-UTR_HSD17B4

SEQ ID NO: 387 - DNA, 42 bp, Artificial Sequence; identical to SEQ ID NO: 21
  5'-UTR_RPL32

SEQ ID NO: 388 - RNA, 42 nt, Artificial Sequence; identical to SEQ ID NO: 22
  5'-UTR_RPL32

SEQ ID NO: 389 - DNA, 84 bp, Artificial Sequence; identical to SEQ ID NO: 13
  5'-UTR_RPL31.1

SEQ ID NO: 390 - RNA, 84 nt, Artificial Sequence; identical to SEQ ID NO: 14
  5'-UTR_RPL31.1

SEQ ID NO: 391 - DNA, 81 bp, Artificial Sequence; identical to SEQ ID NO: 9
  5'-UTR_Ndufa4.1

SEQ ID NO: 392 - RNA, 81 nt, Artificial Sequence; identical to SEQ ID NO: 10
  5'-UTR_Ndufa4.1

SEQ ID NO: 393 - DNA, 159 bp, Artificial Sequence; identical to SEQ ID NO: 15
  5'-UTR_Slc7a3.1

SEQ ID NO: 394 - RNA, 159 nt, Artificial Sequence; identical to SEQ ID NO: 16
  5'-UTR_Slc7a3.1

SEQ ID NO: 395 - DNA, 108 bp, Artificial Sequence; identical to SEQ ID NO: 11
  5'-UTR_Nosip.1

SEQ ID NO: 396 - RNA, 108 nt, Artificial Sequence; identical to SEQ ID NO: 12
  5'-UTR_Nosip.1

SEQ ID NO: 397 - DNA, 75 bp, Artificial Sequence; identical to SEQ ID NO: 5
  5'-UTR_ATP5A1

SEQ ID NO: 398 - RNA, 75 nt, Artificial Sequence; identical to SEQ ID NO: 6
  5'-UTR_ATP5A1

SEQ ID NO: 399 - DNA, 353 bp, Artificial Sequence; identical to SEQ ID NO: 29
  3'-UTR_Gnas.1

SEQ ID NO: 400 - RNA, 353 nt, Artificial Sequence; identical to SEQ ID NO: 30
  3'-UTR_Gnas.1

SEQ ID NO: 401 - DNA, 121 bp, Artificial Sequence; identical to SEQ ID NO: 25
  3'-UTR_CASP1.1

SEQ ID NO: 402 - RNA, 121 nt, Artificial Sequence; identical to SEQ ID NO: 26
  3'-UTR_CASP1.1

SEQ ID NO: 403 - DNA, 57 bp, Artificial Sequence; identical to SEQ ID NO: 23
  3'-UTR_PSMB3.1

SEQ ID NO: 404 - RNA, 57 nt, Artificial Sequence; identical to SEQ ID NO: 24
  3'-UTR_PSMB3.1

SEQ ID NO: 405 - DNA, 187 bp, Artificial Sequence; identical to SEQ ID NO: 35
  3'-UTR_ALB7.1

SEQ ID NO: 406 - RNA, 187 nt, Artificial Sequence; identical to SEQ ID NO: 36
  3'-UTR_ALB7.1

SEQ ID NO: 407 - DNA, 70 bp, Artificial Sequence; identical to SEQ ID NO: 33
  3'-UTR_RPS9.1

SEQ ID NO: 408 - RNA, 70 nt, Artificial Sequence; identical to SEQ ID NO: 34
  3'-UTR_RPS9.1

SEQ ID NO: 409 - RNA, 51 nt, Artificial Sequence
  NLS2 variant
auggccccaaagaagaagcggaaggucgguauccacggagucccagcagcc

SEQ ID NO: 410 - RNA, 48 nt, Artificial Sequence
  NLS4 variant
aagcguccugcugcuacuaagaaagcuggucaagcuaagaaaaagaaa

SEQ ID NO: 411 - RNA, 4107 nt, Artificial Sequence
  Cas9 variant
auggacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacuaa

SEQ ID NO: 412 - RNA, 4203 nt, Artificial Sequence
  Cas9 variant mRNA product
auggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaa

SEQ ID NO: 413 - RNA, 4716 nt, Artificial Sequence
  Cas9 variant mRNA product
gggagagucccgcagucggcguccagcggcucugcuuguucgugugugugucguugcaggccuuauucaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 414 - RNA, 4813 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 415 - RNA, 4497 nt, Artificial Sequence
  Cas9 variant mRNA product
gggagagcggcucggccauuuugucccagucaguccggaggcugcggcugcagaaguaccgccugcggaguaacugcaaagaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 416 - RNA, 4439 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 417 - RNA, 4420 nt, Artificial Sequence
  Cas9 variant mRNA product
gggagagucccgcagucggcguccagcggcucugcuuguucgugugugugucguugcaggccuuauucaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 418 - RNA, 4530 nt, Artificial Sequence
  Cas9 variant mRNA product
gggagaggcgcugccuacggagguggcagccaucuccuucucggcaucaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 419 - RNA, 4585 nt, Artificial Sequence
  Cas9 variant mRNA product
ggggcgcugccuacggagguggcagccaucuccuucucggcaucaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 420 - RNA, 4484 nt, Artificial Sequence
  Cas9 variant mRNA product
gggagagucccgcagucggcguccagcggcucugcuuguucgugugugugucguugcaggccuuauucaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 421 - RNA, 4581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 422 - RNA, 4517 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 423 - RNA, 4466 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 424 - RNA, 4452 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 425 - RNA, 4433 nt, Artificial Sequence
  Cas9 variant mRNA product
gggagagucccgcagucggcguccagcggcucugcuuguucgugugugugucguugcaggccuuauucaagcuuaccauggccccaaagaagaagcggaaggucgguauccacggagucccagcagccgacaagaaguacagcaucggccuggacaucggcaccaacucugugggcugggccgugaucaccgacgaguacaaggugcccagcaagaaauucaaggugcugggcaacaccgaccggcacagcaucaagaagaaccugaucggagcccugcuguucgacagcggcgaaacagccgaggccacccggcugaagagaaccgccagaagaagauacaccagacggaagaaccggaucugcuaucugcaagagaucuucagcaacgagauggccaagguggacgacagcuucuuccacagacuggaagaguccuuccugguggaagaggauaagaagcacgagcggcaccccaucuucggcaacaucguggacgagguggccuaccacgagaaguaccccaccaucuaccaccugagaaagaaacugguggacagcaccgacaaggccgaccugcggcugaucuaucuggcccuggcccacaugaucaaguuccggggccacuuccugaucgagggcgaccugaaccccgacaacagcgacguggacaagcuguucauccagcuggugcagaccuacaaccagcuguucgaggaaaaccccaucaacgccagcggcguggacgccaaggccauccugucugccagacugagcaagagcagacggcuggaaaaucugaucgcccagcugcccggcgagaagaagaauggccuguucggcaaccugauugcccugagccugggccugacccccaacuucaagagcaacuucgaccuggccgaggaugccaaacugcagcugagcaaggacaccuacgacgacgaccuggacaaccugcuggcccagaucggcgaccaguacgccgaccuguuucuggccgccaagaaccuguccgacgccauccugcugagcgacauccugagagugaacaccgagaucaccaaggccccccugagcgccucuaugaucaagagauacgacgagcaccaccaggaccugacccugcugaaagcucucgugcggcagcagcugccugagaaguacaaagagauuuucuucgaccagagcaagaacggcuacgccggcuacauugacggcggagccagccaggaagaguucuacaaguucaucaagcccauccuggaaaagauggacggcaccgaggaacugcucgugaagcugaacagagaggaccugcugcggaagcagcggaccuucgacaacggcagcaucccccaccagauccaccugggagagcugcacgccauucugcggcggcaggaagauuuuuacccauuccugaaggacaaccgggaaaagaucgagaagauccugaccuuccgcauccccuacuacgugggcccucuggccaggggaaacagcagauucgccuggaugaccagaaagagcgaggaaaccaucacccccuggaacuucgaggaagugguggacaagggcgcuuccgcccagagcuucaucgagcggaugaccaacuucgauaagaaccugcccaacgagaaggugcugcccaagcacagccugcuguacgaguacuucaccguguauaacgagcugaccaaagugaaauacgugaccgagggaaugagaaagcccgccuuccugagcggcgagcagaaaaaggccaucguggaccugcuguucaagaccaaccggaaagugaccgugaagcagcugaaagaggacuacuucaagaaaaucgagugcuucgacuccguggaaaucuccggcguggaagaucgguucaacgccucccugggcacauaccacgaucugcugaaaauuaucaaggacaaggacuuccuggacaaugaggaaaacgaggacauucuggaagauaucgugcugacccugacacuguuugaggacagagagaugaucgaggaacggcugaaaaccuaugcccaccuguucgacgacaaagugaugaagcagcugaagcggcggagauacaccggcuggggcaggcugagccggaagcugaucaacggcauccgggacaagcaguccggcaagacaauccuggauuuccugaaguccgacggcuucgccaacagaaacuucaugcagcugauccacgacgacagccugaccuuuaaagaggacauccagaaagcccagguguccggccagggcgauagccugcacgagcacauugccaaucuggccggcagccccgccauuaagaagggcauccugcagacagugaaggugguggacgagcucgugaaagugaugggccggcacaagcccgagaacaucgugaucgaaauggccagagagaaccagaccacccagaagggacagaagaacagccgcgagagaaugaagcggaucgaagagggcaucaaagagcugggcagccagauccugaaagaacaccccguggaaaacacccagcugcagaacgagaagcuguaccuguacuaccugcagaaugggcgggauauguacguggaccaggaacuggacaucaaccggcuguccgacuacgauguggaccauaucgugccucagagcuuucugaaggacgacuccaucgacaacaaggugcugaccagaagcgacaagaaccggggcaagagcgacaacgugcccuccgaagaggucgugaagaagaugaagaacuacuggcggcagcugcugaacgccaagcugauuacccagagaaaguucgacaaucugaccaaggccgagagaggcggccugagcgaacuggauaaggccggcuucaucaagagacagcugguggaaacccggcagaucacaaagcacguggcacagauccuggacucccggaugaacacuaaguacgacgagaaugacaagcugauccgggaagugaaagugaucacccugaaguccaagcugguguccgauuuccggaaggauuuccaguuuuacaaagugcgcgagaucaacaacuaccaccacgcccacgacgccuaccugaacgccgucgugggaaccgcccugaucaaaaaguacccuaagcuggaaagcgaguucguguacggcgacuacaagguguacgacgugcggaagaugaucgccaagagcgagcaggaaaucggcaaggcuaccgccaaguacuucuucuacagcaacaucaugaacuuuuucaagaccgagauuacccuggccaacggcgagauccggaagcggccucugaucgagacaaacggcgaaaccggggagaucgugugggauaagggccgggauuuugccaccgugcggaaagugcugagcaugccccaagugaauaucgugaaaaagaccgaggugcagacaggcggcuucagcaaagagucuauccugcccaagaggaacagcgauaagcugaucgccagaaagaaggacugggacccuaagaaguacggcggcuucgacagccccaccguggccuauucugugcuggugguggccaaaguggaaaagggcaaguccaagaaacugaagagugugaaagagcugcuggggaucaccaucauggaaagaagcagcuucgagaagaaucccaucgacuuucuggaagccaagggcuacaaagaagugaaaaaggaccugaucaucaagcugccuaaguacucccuguucgagcuggaaaacggccggaagagaaugcuggccucugccggcgaacugcagaagggaaacgaacuggcccugcccuccaaauaugugaacuuccuguaccuggccagccacuaugagaagcugaagggcucccccgaggauaaugagcagaaacagcuguuuguggaacagcacaagcacuaccuggacgagaucaucgagcagaucagcgaguucuccaagagagugauccuggccgacgcuaaucuggacaaagugcuguccgccuacaacaagcaccgggauaagcccaucagagagcaggccgagaauaucauccaccuguuuacccugaccaaucugggagccccugccgccuucaaguacuuugacaccaccaucgaccggaagagguacaccagcaccaaagaggugcuggacgccacccugauccaccagagcaucaccggccuguacgagacacggaucgaccugucucagcugggaggcgacaagcguccugcugcuacuaagaaagcuggucaagcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 426 - protein, 17 aa, Artificial Sequence
  NLS2
MAPKKKRKVGIHGVPAA

SEQ ID NO: 427 - protein, 16 aa, Artificial Sequence
  NLS4
KRPAATKKAGQAKKKK

SEQ ID NO: 428 - protein, 1368 aa, Artificial Sequence [sequence omitted]

SEQ ID NO: 429 - protein, 1629 aa, Artificial Sequence
  Cas9
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNN

SEQ ID NO: 430 - protein, 1053 aa, Artificial Sequence
  Cas9
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 431 - protein, 1409 aa, Artificial Sequence
  Cas9
MLFNKCIIISINLDFSNKEKCMTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 432 - protein, 1101 aa, Artificial Sequence
  Cas9
MWYASLMSAHHLRVGIDVGTHSVGLATLRVDDHGTPIELLSALSHIHDSGVGKEGKKDHDTRKKLSGIARRARRLLHHRRTQLQQLDEVLRDLGFPIPTPGEFLDLNEQTDPYRVWRVRARLVEEKLPEELRGPAISMAVRHIARHRGWRNPYSKVESLLSPAEESPFMKALRERILATTGEVLDDGITPGQAMAQVALTHNISMRGPEGILGKLHQSDNANEIRKICARQGVSPDVCKQLLRAVFKADSPRGSAVSRVAPDPLPGQGSFRRAPKCDPEFQRFRIISIVANLRISETKGENRPLTADERRHVVTFLTEDSQADLTWVDVAEKLGVHRRDLRGTAVHTDDGERSAARPPIDATDRIMRQTKISSLKTWWEEADSEQRGAMIRYLYEDPTDSECAEIIAELPEEDQAKLDSLHLPAGRAAYSRESLTALSDHMLATTDDLHEARKRLFGVDDSWAPPAEAINAPVGNPSVDRTLKIVGRYLSAVESMWGTPEVIHVEHVRDGFTSERMADERDKANRRRYNDNQEAMKKIQRDYGKEGYISRGDIVRLDALELQGCACLYCGTTIGYHTCQLDHIVPQAGPGSNNRRGNLVAVCERCNRSKSNTPFAVWAQKCGIPHVGVKEAIGRVRGWRKQTPNTSSEDLTRLKKEVIARLRRTQEDPEIDERSMESVAWMANELHHRIAAAYPETTVMVYRGSITAAARKAAGIDSRINLIGEKGRKDRIDRRHHAVDASVVALMEASVAKTLAERSSLRGEQRLTGKEQTWKQYTGSTVGAREHFEMWRGHMLHLTELFNERLAEDKVYVTQNIRLRLSDGNAHTVNPSKLVSHRLGDGLTVQQIDRACTPALWCALTREKDFDEKNGLPAREDRAIRVHGHEIKSSDYIQVFSKRKKTDSDRDETPFGAIAVRGGFVEIGPSIHHARIYRVEGKKPVYAMLRVFTHDLLSQRHGDLFSAVIPPQSISMRCAEPKLRKAITTGNATYLGWVVVGDELEINVDSFTKYAIGRFLEDFPNTTRWRICGYDTNSKLTLKPIVLAAEGLENPSSAVNEIVELKGWRVAINVLTKVHPTVVRRDALGRPRYSSRSNLPTSWTIE

SEQ ID NO: 433 - protein, 1388 aa, Artificial Sequence
  Cas9
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 434 - protein, 1082 aa, Artificial Sequence
  Cas9
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 435 - protein, 1334 aa, Artificial Sequence
  Cas9
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 436 - protein, 1345 aa, Artificial Sequence
  Cas9
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 437 - protein, 1056 aa, Artificial Sequence
  Cas9
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 438 - protein, 1082 aa, Artificial Sequence
  Cas9
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 439 - protein, 1084 aa, Artificial Sequence
  Cas9
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 440 - protein, 984 aa, Artificial Sequence
  Cas9
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 441 - protein, 1121 aa, Artificial Sequence
  Cas9
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 442 - protein, 851 aa, Artificial Sequence
  Cas9
MTNGKILGLDIGVASVGVGIIEAKTGKVIHANSRLFSAANAENNAERRGFRGARRLTRRKKHRVKRVRDLFEKYDILTDFRNLNLNPYELRVKGLTEQLTNEELFAALRTIAKRRGISYLDDAEDDSTGSSDYAKSIDENRRLLKSMTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVNFAKNSKTLGASKLLKEIAKLVDGDVKDISGYREDSKGKPDLHTFEPYRKLKFNLTTVDIDNLSRDILDKLADILTLNTEREGIEDAINQNLPEQFTKEQISEIVQIRKSQSSAFNKGWHSFSAKLMNELIPELYATSEEQMTILTRLEKFKATKKSSKNTKTIDEKEITDEIYNPVVAKSVRQTIKIINAAVKKYGDFDKIVIEMPRDKNADDEKKFIDKKNKENKKEKDDSLKRAAYLYNGTDKLPDDVFHGNKQLATKIRLWYQQGERCLYSGKPILIQDLVHNSNNFEIDHILPLSLSFDDSLANKVLVYAWANQEKEQKTPYQVIDSMDAAWSFREMKDYVLKQKGIGKKKREYLLTTENIDKIEVKKKFIERNLVDTRYASRVVLNSLQTALKELGKDTKVSVVRGQFTSQLRRKWKIDKSRETYHHHAVDALIIAASSQLKLWQKHENLMFENYGENQVVNKETGEILSISDDEYKESVFQPPYQGFVNTISSKAFEDEILFSYQVDSKFNRKVSDATIYSTRKAKLGKDKKEETYVLGK

SEQ ID NO: 443 - protein, 865 aa, Artificial Sequence
  Cas9
MRHKIGLDIGITSVGWAVINLDIPRIEDLGVRIFDRAENPQTGESLALPRRLARSARRRLRRRKHRLERIRRLLIREGILTKEELDKLFEEKHEIDVWQLRVEALDRKLNNDELARVLLHLAKRRGFKSNRKSERNNKENSTMLKHIEENRALLSGYRTVAEMIVKDPKFAFHKRNKGENYTNTIARDDLEREIKLIFTKQREYGNIVCTETFENEYIMIWASQRPFASKNDIEKKVGFCTFEPKEKRAPKATYTFQSFVAWEHINKLRLVYPTGTRGLTDEERRLLYKQAFHKNKITYHDIRTLLHLPDDTYFKGIVYDRGAPLKQSETIRFLELDAYHQIRKAVDKVYGKGKSSSFLPIDFDTFGYALTLFKDDADIRSYLRNEYEQNGKRMPNLANKVYDNEPIEELLNLSFTKFGHLSLKALRNILPYMEQGEVYSVACERAGYTFTGPKKKQKTLLLPNIPPIANPVVMRALTQARKVVNAIIKKYGSPVSIHIELARDLSQTFDERRKTKREQDENRKKNETAIRQLMEYGLTINPTGHDIVKFKLWSEQNGRCAYSLQPIEIERLLEPGYVEVDHVIPYSRSLDDSYTNKVLVLTKENREKGNRIPAEYLGVGTERWQQFKTFVLTNKQFSKKKRDRLLRLHYDENEEAEWKNRNLNDTRYISRFFANFIREHLKFAESDDKQKVYTVNGRVTAHLRSRWDFNKNREESDLHHAVDAAIVACTSPSDIARVTAFYQRREQCKESAKKAEPHFPQPWPHFADELRARLSKNPKESIKALNLGNYDDQKLESLQPVFVSRMPKRSVTGAAHQETLRRYIGIDERSGKIQTVVKTKLSEIKLDETGHFPMYGKESDPPASA

SEQ ID NO: 444 - protein, 961 aa, Artificial Sequence
  Cas9
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNIGFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKLSDLQDEKMLEIDHIYPYSRSFDDSYMNKVLVFTKQNQEKLNKTPFEAFGNDNVKWQKIEVLAKNLPEKKQKRILDKNYKDKEQKDFKDRNLNDTRYIARLVLNYTKDYLDFLPLSDDENTKLKGSKVHVEAKSGMLTSALRHTWGFSTKDRNNHLHHAIDAAIIAYANNSIVKDFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNLKVFEKYIVSALGEVTKAEFRQREDFKNELR

SEQ ID NO: 445 - protein, 984 aa, Artificial Sequence
  Cas9
MAKILAFDIGISSIGWAFSENDELKDCGVRIFTKAENPKTGESLALPRRIARSARKRLARRKARLNHLKHLIANEFKLNYEDYQSFDEILAKAYKGSLISPYELRFRALNELLSKQDFARVILHIAKRRGYDDIKNNGDEEKGKILKAIKQNEEKLANYQSVGEYLYKEYFQKFKENSKEFINVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTLYTKDDLNALLNEVLKNGTLTYKQTKKLLGLSDDYEFKGEKGNYFIEFKKYKEFIKALGEHSLSQDDLNEIAKDITLIKDEIKLKKALAKYDLNENQIDNLSKLEFKDHLNISFKALKLITPLMLEGKKYDEACNELTLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNTAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREEFKNELR

SEQ ID NO: 446 - protein, 984 aa, Artificial Sequence
  Cas9
MARILAFDIGISSIGWAFSENDELKDCGVRIFTKAENPKTGESLALPRRLARSARKRLARRKARLNRLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEFLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTHKGSKVHVEAKSGMLTSALRHTWGFSTKDRNNHLRHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 447 - protein, 984 aa, Artificial Sequence
  Cas9
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVTLTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 448 - protein, 984 aa, Artificial Sequence
  Cas9
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 449 - protein, 984 aa, Artificial Sequence
  Cas9
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 450 - protein, 984 aa, Artificial Sequence
  Cas9
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDFYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 451 - protein, 984 aa, Artificial Sequence
  Cas9
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEFLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKIAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 452 - protein, 984 aa, Artificial Sequence
  Cas9
MVRILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 453 - protein, 984 aa, Artificial Sequence
  Cas9
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 454 - protein, 985 aa, Artificial Sequence
  Cas9
MAKILAFDIGISSIGWAFVENDELKDCGVRIFTKAENPKTGESLALPRRLARSARKRLARRKARLNHLKHLIANEFKLNYEDYQSFDESLAKAYKGTLISPYELRFKALNELLSKQDLARVILHIAKRRGYDNIKNSDDKEKGAILKAVKENEEKLANYKSVGEYLYKEYFQKFKENSKEFINVRNKKESYERCIAQSFLKDELKLIFQKQREFGFNFSKKFEEEVLSVAFYKRALKDFSHLVGNCSFFVDEKRAPKNSPLAFEFVALTRIVNLLNNLNKNNSYIKDDLNALLSEVLKNGTLTYKQTKKILGLSDDYEFKGQKGNYFIEFKKYKEFIKALCEHNLNQDDLNEIAKDITLVKDETKLKKALAKYDLNQNQIENLSKIEFKDHLNISFKALKLIVPLMREGKKYDEVCNELNLKTAINEDKKEFLPAFNETYYKDEVNNPVVLRAIKEYRKVLNSLLKKYGKVHKINIELAREVGKNHRERSKIEKEQNENFKAKKDAELECEKLGLKINSKNILKLRLFKEQKEFCVYSGEKIKISDLQDEKMLEIDHIYPYSRSFDDSYMNKVLVFTKQNQEKLNKTPFEAFGKDDVKWQKIETLAKNLPAKKQKRILDKNYKDKEQKDFKDRNLNDTRYIARLVLNYTKDYLEFLPLSDDENIKLNDTQKGSKVHVEAKSGMLTSVLRHTWGFSTKDRNNHLHHAIDAVIIAYANASVVKAFSDFKKEQENYTAELYAKKINELDFKNKRKFFEPFSNFRQKVLEKIDEIFVSKPERKKPSGALHEETFYKEEEFYKEYGGKEGVLKALELGKIRKVNGKIVSNANMFRVDIFKYKKTNKFYAVPIYTMDFALGILPNKAVVGGKDKQGIIKDWLLMDENYEFCFSLYKDSLILLQTKDMQEPELVYFKSFKSSTAGLVVSKHDNKFENLNENQKKLFKSANEKKVVAEGIGIQNLKVFEKYIVSALGEITKAEIKERENFKKK

SEQ ID NO: 455 - protein, 986 aa, Artificial Sequence
  Cas9
MPSDPAEAKPLELLDPYALRAQGLDQALPLTHFGRALFHLNQRRGFKSNRKTDRGDNENGKIKDASQRLDWAMHEAKARTYGEFLHLRRQKAPDPRQVPTVRTRLSVGKRGGPDAKEEAGYDFYPDRRHLEEEFHELWSAQAQFHPELTQDLRDLVFEKIFYQRPLKEPKVGLCLFTSEERLAKAHPLTQRRVLYETVNQLRITADGRSVRPLSREQRDQIILALDTKKPTKSLNSMVVTLQALGKVLKLREGERFTLESGVREAIACDPVRAAMLATFGPRWSALDWPEQWQVISRVRKLQDDKDFAELVEWLIELYGVDKEAAVKIANTHLPEGYGRLGLTATTRILDRLKSNVFTYAQAVAACGWHHSDQRTGECLDRLPYYGAVLDRHVIPGTYDENDDDITRFGRITNPTVHIGLNQLRRLVNKIIEVYGKPNQIVVELARELKQSEQQKNDAIKLIRDTTTAAKQRSEKLEELGITDNGRNRMLLRLWEDLNPDDAMRRFCPYTGQRISAAMIFDGSCDVDHILPYSRTLDDGFANRTLCLREANREKRNQTPWEAWGGTPNWEAIETNLKNLPENKRWRFAPDAMARFEGENDFLDRALVDTQYLARISRTYLDTLFTEGGHVWVVPGRLTEMLRRHWGLNSLLTDKDRGAVKSKNRTDHRHHSIDAAVVAATDRSLLNRISRAAGQGEVAGQSAELIARETPPPWEGFRNDLKSQLGRIIVSHRADHGRIDRQARKQGRDSTAGQLHQETAYSIVDDTRVASRIDFLSVKPAQLLDQPGRSGQVRDLQLRKALRVATGDLTGKDYEKALRDFAAKPGPYKGIRRVRIIKPLQEQARVPVPVLDPIKAYQGGSNHVFEIWHLPDGKVEPQVITSFEAHALEVEKRPHPAAKRLLRVHKGDMVALKREGRTVVGHVQQMHIKNGLFIVPHNEANADARNSDRTDPFKWIQIAAQPAIAAGIRRVAVDEIGRLRDGGAKTI

SEQ ID NO: 456 - protein, 987 aa, Artificial Sequence
  Cas9
MARILAFDIGISSIGWAFSENDELKDCGVRIFTKAENPKTGESLALPRRLSRSARKRLARRKARLNHLKHLIANEFKLNYEDYQSFDESLAKAYKGSLISPYELRFRALNEFLSKQDFARVILHIAKRRGYDDIKNNGDEEKGEILKAIKQNEEKLVSYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRDNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKMVKNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 457 - protein, 987 aa, Artificial Sequence
  Cas9
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 458 - protein, 987 aa, Artificial Sequence
  Cas9
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLVFMFVALTRIINLLNNLKNTEGILYTKDDLNALLNEVLKNGTLTYKQTKKLLGLSDDYEFKGEKGTYFIEFKKYKEFIKALDEHSLSQDDLNEIAKDITLIKDEIKLKKALAKYDLKENQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFAKQNQEKLNKTPFEAFGNDSTKWQKIEVLTKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 459 - protein, 987 aa, Artificial Sequence
  Cas9
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 460 - protein, 987 aa, Artificial Sequence
  Cas9
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNSTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 461 - protein, 987 aa, Artificial Sequence
  Cas9
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 462 - protein, 992 aa, Artificial Sequence
  Cas9
MRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 463 - protein, 994 aa, Artificial Sequence
  Cas9
MTLGLDLGTNSIGWALIDFDDNQQPRNLIACGSRIFQEAVEAKTGTPKNHARRTARAARKLVARRKQRRTKLLNLLIRHGLLPQDVAERNALLLDNQANNPYQLRKRGLDEKLEPFAFGRALYHLAHRRGFQSNRKAASDEDGKVKTAISTLRAEMQGRTLGAFLADQPTQRRRYTDRAMYVEEFEQLWSKQASFTQEQLTQALKVAIHNSIFFQRPLKSQKHLVGKCTFEPTRKRAAKAILLTQRFRILQDVNHLAVKNPITREFRPLTQDERNKLAEALDKQKSMTWGAVRKVIGWNKKDSLHEGETFNLEEGKKDKLIGNRTACDLRGALGDRWDALTAQQQDDLVTDLLTIDNTDGFLKRMKTHWEFDDATAEVIAKIELEPGYARLSAKAMRAILPYLEQGMIYSDACKAAGYDHSNPNQRTITDKLGLPSNVRNPVVQKALFETRKVVNAIVRKYGKPAVIRVEMARDMKLSKRQKEELQKEQNKQKKANELAEGILRKEFGIQQPARADIQKYNLWLECKEVCPYTGTTISREMLFSPEVDVEHILPYSRSLDDSYMNKTLCMATFNRQVKLNNTPYEIGQGDPLAYAEIFQRIKTLPFPKRRRFEQKEIETDKFIERQLNDTRYICVEVRDFLQQLGAPVEVSKGEATAKLRGRWKLNTLLSPDGSNEKYRGDHRHHAIDAVVIALTNRSLFHKLSRLSAQSISLDKSRFDVPPPWDGFYDDVYEKIDKVIVSHAPARKIGGALHEDTAYGHFKEEVADPKTGKVSIEDRFVYRKPLATLTANEVGKIRDAKVREFVEARLAQFGNNSKTAFGDPNNPLLHADGKTPIRTVRLVTNFNKATTHAIQKGQGRDYKFFKYGNNHHVEIIEHVETGKRKGIFVTAMEAARRVRGVANTEKSDIVQRNHGEEWRFVMSLSINDLVSIQEADQVRIMRVQLFDASNGNIIFRDQKSAMLDDKLSRYQTKAHLLVCQKITTDPLGNLAPCND

SEQ ID NO: 464 - protein, 995 aa, Artificial Sequence
  Cas9
MSKVLGLDIGANSIGWALIDDEENDIIGAGVRVFKEGVNLKGVKEESKNVERRAARLARRQHKRRSQRRNRLVALLKTLEMFPENNEDISDYYAQDPYELRKKGLYEKLTMYEFGRVLLHICRRRGFKSSRKTDISEEGKIFEGKDGIVGINQTRDSIREGGFKTIGEYLASLDPHVIRRRNRFTLRDMYEEEFNLMWEKQQSFYPLQLSNEFKEAIAEVILSQRKLKSQKALVGNCGLEPNKKTAPKSSPAFQYFRILEQLSRILISIPHTGRYNDPLNEEERRMLIDKLSVTEKLKFSDMRKMLNLPGESDINIEEEGGRLLGNTTYARLIKVFGKKRWAGFSEEEKEQIWHTFHFADNHEWLKEYALKKWSITPDEIKELGKVALEKEYARFSKKSLKKIIPQLEEGLTLDKAKIEAGYTPEYEIEKSLSAYLPLPENIRNPIVQQALYELRHVVNAVIRTYGKPDIARVELAREMKKPKQKREKMRSELRKRQMKFEEIKSILKERLGFIDPKRDEIHKYMLWEECRETCPYTGRKISLSALYGGDFEVEHIIPYKRSLDDSLFNKTVCLREENQIKGDRTPYEAYSGDRQKYEEIILRVQKTSMPRGKKNLFAIKELKDDFAHRQLSDTAYISRETRKYLGSTIKKVQAVKGGSTAKLRYYWGLNSILGVRDIKMRDDHRHHAVDALVIANTTYAFVNTLSRYHSMDVEPHESRFPLPWEQFRNDAESVVRNIFVSHRLGKKATGQLHEETYYGKIRNTDGEPYFVVRKKLGTLTAKQIANIVDPVVKTQVFERLEEKGIDIESSNKIPADAFVETLYMPDRKTPIKSVRVKVPSTTMIQLYKDKELYVDPGSNHHIVIFENEEGKRDGIVVSLFEAAQRLRRNEPVIQKTWKPEWHFVMSLSIDELILLDVDEKNIDWGDTGLALRYSKALYRVQKMDVNKIITLRHHLVARLKDDEGKEFGREHRIPSTLRGLKVKIDHIGRLRRAYD

SEQ ID NO: 465 - protein, 995 aa, Artificial Sequence
  Cas9
MKVIGFDIGINSIGWAFVENDELKDCGVRIFTKAENPKNKESLALPRRNARSSRKRLKRRKLRLIAMKHILAKELNLNYKDYIANDGELPKAYEGKLISPYELRYKALNQKLEAKDLVRVILHIAKHRGYMNKNDKKSNDAEKGKILSALKNNALKLEKYQSVGEYFYKEFFQKYKENTKDFIKIRNIKDNYNNCVLASDLEKELKLILEKQKEFGYSYSNDFIEEVIQVAFFQRPLKDFSHLVGTCTFFEEEKRACKNSYSAWEFVALTKIVNELKSLEKISGELISTQTINEILNYILDKGSITYKKFRSYINLYESIKFKSLKYDKDNAESAKLIDFRKLVEFKKALGEHYFNRQELDQISTYITLIKDNVKLKTALEKYNLSNEQINNLLEIEFNDHINLSFKALSMILPLMKEGKKYDEACEIANLKPKTTNQKQDFLPAFCNSIFVHELSNPIVNRAISEYRKVLNALLKKYGKVHKIHLELARDIGLSKKAREKIEKEQKENQAINTWALNECENMGIKANAKNILKLKLWKEQKEICIYSGKKISIEHLKDEKALEVDHIYPYSRSFDDSYMNKVLVFTKENQEKLNKTPFEAFGKNIEKWNKIQTLAQILPYKKKNKILDENFKDNQQQDFISRNLNDTRYIATLIAKYTKEYLNFLPLNENENINLKSGEKGSKIHIQTVNGMLTSVLRHTWGFDKKDRNNHLHHALDAIIVAYSTNSLIKAFSDFKKNQELLKAKLYAKELTNDNYIHQAKFFEPFEGFREKILNKIDEIFVSKPPRKRARGALHKETFYSEKKMIKKYNSKEGLNIALDCGKIRKIGTKYVENDTMVRVDIFKKQNKFYAIPIYTMDFALGILPNKIVVIGKDKNNNPKQWQEIDESYEFCFSLYKNDLILLQKKDMQEAEFAYYNGFDIDSSRINIKKHDNKFENLTSNQKLLFTNKEKNRTGIQNLKIFEKYIVTPLGNKIKADFQPRQNISLKSSKKNGL

SEQ ID NO: 466 - protein, 995 aa, Artificial Sequence
  Cas9
MKILGFDIGINSIGWAFVENDELKDCGVRIFTKAENPKNKESLALPRRNARSNRRRLKRRKSRLIAIKHILAKELNLNYKDYIANDGELPKAYEGKLTNVYELRYKALNQKLEAKDLARVILHIAKHRGYMNKNEKKSNDSEKGKILSALKNNALKLEKYQSVGEYFYKEFFQKYKENTKNFIKIRNTKDNYNNCVLASDLEKELKLILEKQKEFGYSYNDDFIKEIINIAFFQRPLKDFSHLVGSCTFFEEEKRACKNSYSAWEFVALSKIINELKRLEKISGELISAQTINEILNHILDKGNITYKKFRSCINLHESIEFKSLNYDKDNAESAKLVDFKKLIEFKKALGEHSFNRQELDEIATHITLIKDNDKLKTALEKYNLNNEQINALLEIEFNDHINLSFKALNLILPLMREGKRYDEACEIVNLKSKTSNQKQDLLPAFCDSIFSQELSNPVVNRAISEYRKVLNALLKKYGKVHKIHLELARDVGLSKKAREKIEKEQKENKEINDWALDECEKFGLKANNKNILKLKLWKEQKEICAYSGKKISIEHLKDEKALEVDHIYPYSRSFDDSYMNKVLVFTKENQEKLNKTPFEAFGKNIERWNKIQALAQNLPYKKKNKILDENFKDKQQQDFISRNLNDTRYIATLIAKYTKEYLNFLPLNENENTNLKSGEKGSKIHVQTINGMLTSVLRHTWGFDKKDRNNHLHHALDAIIVAYSTNSIIKAFSDFKKNQELLKAKLYAKELTSDNYKHQAKFFEPFEGFREKILNKIDEIFVSKPPRKRARGTLHKETFYPEETMIKKYNSKEGLNIALNCGKIRKIGTKYVENDTMVRLDIFKKQNKFYAIPIYTMDFALGILPNKIVIAGKDKNNNPKQWQEIDESYEFCFSLYKNDLILLQKKDMQEAEFAYYNSFDIDSSRINIKKHDNKFENLTDNQKLLFTNQEKNRTGIQNLKIFEKYIVTPLGDKIKADFQPRQNISLKTSKKYGL

SEQ ID NO: 467 - protein, 996 aa, Artificial Sequence
  Cas9
MMGNFTLGLDLGTNSIGWALIDFDDNQQPQNLIACGSRIFQEAVEAKTGTPKNHARRAARAARKLVARRKQRRTKLLNLLVCHDLLPQDEAERNALLLDNQANNPYQLRKRGLDEKLEPFAFGRALYHLAHRRGFQSNRKAASDEDGKVKTAISALRAEMQGHTLGAFLADQPTQRRRYTDRAMYAEEFEQLWSKQTIFAPEQLTQALKVEIKNSIFFQRPLKSQKHLVGKCTFEPTRKRAAKAILLAQHFRILQDVNHLAVKNPITREFRPLTQDERNKLAEALDKQKGMNWSAVRKVIGWNKKDSLHEGETFNLEEGKKDKLIGNRTACDLRGALGDRWDAFTAPQQDDLVTDLLTIDNPDGFLKRMKTHWGFDDATAEALATTELEPGYARLSSKAMRAILPHLEQGMIYSDACKAAGYDHSNPNQRTITDKLGLPSNVRNPVVQKALFETRKVVNAIVRKYGKPAVIRVEMARDMKLSKRQKEELQKEQNKQKKANELAEGILRKEFGIQQPARTDIQKYNLWLECKEVCPYTGTVISREMLYSPEVDVEHILPYSRSLDDSYMNKTLCMATYNRQTKLNNTPYEIGQGDPVAYAEIFQRIKTLPFPKRRRFEQKEIETDKFIERQLNDTRYICVEVRDFLQQLGAPVEVSKGEATAKLRGRWKLNTLLSPGGGNEKNRADHRHHAIDAVVIALTNRSLFHKLSRLSAQSISFDKSRFDVPPPWDDFYDDVYEKIDKVIVSHAPTRKISGALHEATAYGHFKEEIADPKTGKFSIEDRFVYRKPLTTLTANEVGKIRDAKVRELVEARLAQFGNNSKAAFGDPNEPLLHADGKTPIRTIRLTTNFNKTTTHAIQKGQDRDYKFFKYGNNHHVEIIEHVETGKRKGIFVTAMEAARRARGVANTEKSNIVQRNHGDGWKFVMSLAVNDMVRTEDTQAIYRVQKLDGSNNRFTLRSHNAATLDDKQTGVDKTPNLFKGTKIIVDPLGNLTQCND

SEQ ID NO: 468 - protein, 997 aa, Artificial Sequence
  Cas9
MKVLVDAGLMPSDPAAAKALETLDPYELRATGLDVMLPLTHLGRAVFHLNQRRGFKSNRKTDRGDNESGKIKDATKRLTWAMQEAGARTYGEFLHMRRARASDPRQVPSVRTRLSVASRGGPDSKEEAGYDFYPERAHLEDEFHALWSAQAAFHPDLTCELRDVVFEKIFYQRPLKEPKVGLCLFTAEERLPKAHPLTGRRVLYETVNQLRVTADGRTTRPLTLEERDMIVYALDNKKPVKSLSSMHLKLVALGKLVKLKDGERFTLESGVRDAIACDPIRATMGHPDGFGPAWSRLDWQAQWALIEKLRQVQSDDDFASLVAWLGATHNLSEDHAKRVANLHLPEGYGRLGLTATEAILCNLKAEVCTYSQAVERWGKHHSNQRTGECLEALPYYGEVLDRHVIPGTYNEDDDDVTRYGRITNPTVHIGLNQLRRLVNRIIATYGKPDQIVVELARELKQSEAQKSEALKKIRDTTADAIRRGRQLEEIGQKNTGANRLLLRLWEDLGPAVGPRCCPYTGKPISVTMLFDGACDVDHILPYSRTLDDSFANRTICLREANRQKGDRTPWEAWGGSDQWDAIEANLKDLPENKRKRFAPDAMERFEGERDFLDRALVDTQYLARISRAYLDTLFTEGGHVWVVPGRMTEMLRRHWGLNALLSDKDRGAGKVKNRTDHRHHAIDAAVIAATDHSLVNRISKAAGQGESAGQSAELIARDTPEPWEGFRNDISAQIARIVVSHRADHGRIDVEGRKHGKDSTAGRLHNDTAYGIVDDHTVVSRTPLLSLKPGDIEVTTKGKNIRDTQLQKALSVATTGKDGKGFEEALRNFAEKEGPYQGIRRVRLIETLQSSARVEVGSDEDGQPLKAYKGDSNHCYDLWKLPDGKVVPHVVSTYEAHAGTDKRPHPAAKRILRVFKKDMVAIEQDDQTAIFYVQKLDRANGLFLAPHLEANADARHRNPNDAFKFLQMGAGSVVRNKLRRVYVDEIGRIKDPGPPKH

SEQ ID NO: 469 - protein, 997 aa, Artificial Sequence
  Cas9
MKILGFDIGINSIGWAFVENDELKDCGVRIFTEAENPSNKESLALPRRNARSSRRRLKRRKARLVAIKRILAKELKLNFKDYVAADGELPKAYEGKLTSIYELRYKALIQQLETKDLARVILHIAKHRGYMNKNEKKSNDTKKGKILSALKNNALKLENYQSVGEYFYKEFFQKYKENTKNFIKIRNTKDNYNNCVLSSDLEKELKLILEKQKEFGYNYSEDFINEILKVAFFQRPLKDFSHLVGACTFFEEEKRACKNSYSAWEFVALTKIINEIKSLEKISGEIVPTQTINEILNLILDKGSITYKKFRSCINLHESISFKSLKYDKENAENAKLIDFRKLVEFKKALGVHSLSRQELDQISTHITLIKDNVKLKTVLEKYNLSNEQINNLLEIEFNDYINLSFKALGMILPLMREGKRYYEACEITNLKPKTVDEKEDFLPAFCDSIFAHELSNPVVNRAISEYRKVLNALLKKYGKVHKIHLELARDVGLSKKAREKIEDQQKNNKAINDWALKECENIGIKASAKNILKLKLWKEQKEICIYSGNKISIEHLKDEKALEVDHIYPYSRSFDDSFINKVLVFTKENQEKLNKTPFEAFGKNIEKWSKIQTLAQNLPYKKKNKILDENFKDKQQQDFISRNLNDTRYITTLIAKYTKEYLNFLPLSENENTNLKSGEKGSKIHIQTISGMLTSVLRHTWGFDKKDRNNHLHHALDAIIVAYSTSSIIKAFSDFKKNQELLKARFYAKELTSDNYKHQVKFFEPFKGFREKILSKIDEIFVSTPPRKRARGALHEETFYSEDKMIKKYNSKEGLQIALSCGRVRKIGTKYVENDTMVRVDIFKKQNKFYAIPIYVMDFALGILPNKIVITGKDKNNNPKQWQTIDESYEFCFSLYKNDLILLQKKNMQEPEFAYYNSFDIDRSRIKIKKHDNKFENLTSNQKLLFTNKDKGKNRTGIQNLKIFEKYIVTPLGDKIKADFQPRENISLKTSKKHGL

SEQ ID NO: 470 - protein, 997 aa, Artificial Sequence
  Cas9
MGNYTLGLDIGSNSIGWALVEDAVEAPRIVDMGVRVFPEGVDRDTKGLEKSKNATRREARGARRTHQRRRQRKQRLVRALRQVGLLPCDKAEVRSLFQTDPYEIRKRGLDHRLELYEIGRAFYHLSQRRGFKSNRKSGALKEDGTVKKEAGELQRKIDEAGCRTIGEYFAGLDPEQQRIRGRYTFRSMYQKEFDLLWAKQVEFYPKVLTEDLRSKVRDEIIFFQRPLKSAKDLIGDCELEPTEKRCPRADWYARRFRLLQDINNLIIQNPDGTEQKLSPDQRAALLGELGQREKLTFDNIRAKLGLLETQKFNAEYRIGRKGKKVEAIKGDVFVWTMRGKSVFGPKAWDAMADERKVSLNELFVELEDDDLARKLETEYGLTDKQVQAAMKASLPQGYMSFSRKAVLKLLPFMEAGALTHEAIDQAGYRKEEPTQTDAIARVSFPPDLRNPIVQKALFEVRKVVNALVREYGKPTRIKIEMARDVQGSKRQREELHWRNEDNRKKNEEVRDRLRTDIHIDDPSRDDVIKYKLWQESGKMCPYTGRQICQEALFGPNPEFQVEHILPYDRSLDDSYMNLTLCEVHENIHGKRNQTPFEAYGSGAERYEQIKQRIKVLPWPKRQKFLQQEINLDSHISRELNDTRYICRETVAYLKQLGVHVRGTRGKITAELRHQWGLDGIFSELGVRRDDDHRRHAVDALVVAVTDNEHLRRLAVSKYVLAGPRFETPWSAFRDEARGNVKRMNVSHRVCRKVSGALHEETNYGPTGVRDQAGQDIYAYRKKLEDLTTPMVEKIVDPVVRDIVRQRLLMKGIDPAAADRKIPKDVWKEPLYMRRTKSDKMIQIRRVRIHDVKNSIIVLTDESGRPYRAVEPGGNHHVEVFEYVHGTKTGTREAEVVTMFEAVRRSRARAPVVRRDHGPGTRFVCSLAINDMVMMPDKSGKMDLFRIQKMSASKQVYFRHHTAARIDSERTLIRKQAHLFNGYKVSVDPTGAICRAND

SEQ ID NO: 471 - protein, 999 aa, Artificial Sequence
  Cas9
MKILGFDIGINSIGWAFVEDNQLQDCGVRLFTKAEDPKTKESLALPRRNARSNRRRLGRRRSRLIALKHIISKGLKLNYQDYIANDGELPKAYEGRLISPYELRYKALNEKIEPKDLARVILHIAKHRGYMNKNEKKSSDNEKGKILSALKTNALKLEKYQSVGEYFYKEFFQKYRENTKDFINIRNKEGSYENCVLASDLEKELKLILEKQKEWGYSYNDNFIKEILKVAFFQRPLKDFSYLVGACTFFEDEKRACKNSYSAWEFVALTKIINELKSLEKESGELVSSQIINEILNHILDKGSITYKKFREYIKLHESMKFKSLKYDKDNVESTKLIEFRKLVEFKKALGEHSLSREELDQIATYITLIKDNEKLKITLEKYSLNNEQIKNLLEIDFNDHINLSFKALNLILPLMKEGKRYDEACKLLNLKTKSNNQKFDFLPAFCDSIFAQELTNPIVNRAISEYRKVLNALLKKYGKMHKIHIELARDIGLSKKLRAKIEKEQKENYENNIWALNECEKFGLKANAKNILKLKLWKEQKEFCIYSGKKISIEHLRDEKALEVDHIYPYSRSFDDSFLNKVLVFTKENQEKLNKTPFEAFGANEERWSKIQALAQNLPYKKKNKILDEAFKGKQQQDFISRNLNDTRYISTLIVKYTKEYLDFLPLDEKEDVNLKSGEKGSKIHVQTINGMLTSVLRHTWGFAQKDRNNHLHHALDATIVAYSTNAIIKAFSDFKKEQELLKAKLYAKELTSDSYKHQAKFFEPFEGFREQILNQINKLFVSKPPRKRARGALHKETFYSKDEMIKKYNSQEGVEIALNCGKIRKIGTKYVENDTMVRIDIFKKQNKFYAIPIYTMDFALGVLPNKIVIIGKDKKGNPKQWQEIDESYEFCFSLHKDDLVLIQKKDMQEPEFAYYNGFDISNSSICVEKHDNKFENLTDNQRLLFTNAEGNVKAKKIGIQGLRIFEKYIITPLGEKIKADFKPREDIALKTSKKHGL

SEQ ID NO: 472 - protein, 1000 aa, Artificial Sequence
  Cas9
MKILGFDIGINSIGWAFVENDELKDCGVRIFTKAENPKNKESLALPRRNARSSRRRLKRRKARLIAIKRILAKELKLNFKDYVAADGELPKAYEGSLASVYELRYKALTQKLETKDLARVILHIAKHRGYMNKNEKKSNDAKKGKILSALKNNALKLENYQSVGEYFYKEFFQKYKENTKNFIKIRNTKDNYNNCVLSSDLEKELKFILEKQKEFGYKYSEGFINEILKVAFFQRPLKDFSHLVGACTFFEEENRACKNSYSAWEFVALTKIINEIKSLEKISGEIVSTQTINEVLNLILDKGSITYKKFRSCINLHESISFKSLKYDKENAENAKLIDFRKLVEFKKALGVHSLSRQELDQISTHVTLIKDNVKLKTVLEKYNLSNEQINNLLEIEFNDYINLSFKALGMILPLMREGKRYDEACEITNLKPKTVDEKKDFLPAFCDSIFAHELSNPVVNRAISEYRKVLNALLKKYDKVHKIHLELARDVGLSKKAREKIEKEQKENQAVNAWALKECENIGLKASAKNILKLKLWKEQKEICIYSGNKISIEHLKDEKALEVDHIYPYSRSFDDSFMNKVLVFTKENQEKLNKTPFEAFGKNIEKWSKIQTLAQNLPYKKKNKILDENFKDKQQEDFISRNLNDTRYIATLITKYTKEYLNFLPLNENENTNLKSGEKGSKIHVQTVNGMLTSVLRHTWGFDKKDRNNHLHHALDAIIVAYSTNSIIKAFSDFKKNQELLKARFYAKELTSDNYKHQVKFFEPFKGFREKILSKIDEIFVSKPPRKRARGALHKETFYSEDEMIKKYNSKEGLQIALSCGRVRKIGTKYVENDTMVRVDIFKKQNKFYAIPIYAMDFALGILPNKIVVVGKDKNNNPKQWQTIDESYEFCFSLYKNDLIMLQKKDMQEAEFAYYNGFDISTSSICVEKHDSKFENLTSNQKLLFSNAKEGSVKVENLGIQNLKIFEKYIITPLGDKIKADFQPRENISLKTSKKNGL

SEQ ID NO: 473 - protein, 1000 aa, Artificial Sequence
  Cas9
MARAQRRLISRRANRMNKLRRLLKQENVLQANDYDEKGLIIGLPNQAWELRAQGLDRKLEPKEWAAVLINLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQEQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 474 - protein, 1003 aa, Artificial Sequence
  Cas9
MRILGFDIGINSIGWAFVENDELKDCGVRIFTKAENPKNKESLALPRRNARSSRRRLKRRKARLIAIKRILAKELKLNYKDYVAADGELPKAYEGSLASVYELRYKALTQNLETKDLARVILHIAKHRGYMNKNEKKSNDAKKGKILSALKNNALKLENYQSVGEYFYKEFFQKYKKNTKNFIKIRNTKDNYNNCVLSSDLEKELKLILEKQKEFGYNYSEDFINEILKVAFFQRPLKDFSHLVGACTFFEEEKRACKNSYSAWEFVALTKIINEIKSLEKISGEIVPTQTINEVLNLILDKGSITYKKFRSCINLHESISFKSLKYDKENAENAKLIDFRKLVEFKKALGVHSLSRQELDQISTHITLIKDNVKLKTVLEKYNLSNEQINNLLEIEFNDYINLSFKALGMILPLMREGKRYDEACEIANLKPKTVDEKKDFLPAFCDSIFAHELSNPVVNRAISEYRKVLNALLKKYGKVHKIHLELARDVGLSKKAREKIEKEQKENQAVNAWALKECENIGLKASAKNILKLKLWKEQKEICIYSGNKISIEHLKDEKALEVDHIYPYSRSFDDSFINKVLVFTKENQEKLNKTPFEAFGKNIEKWSKIQTLAQNLPYKKKNKILDENFKDKQQEDFISRNLNDTRYIATLIAKYTKEYLNFLLLSENENANLKSGEKGSKIHVQTISGMLTSVLRHTWGFDKKDRNNHLHHALDAIIVAYSTNSIIKAFSDFRKNQELLKARFYAKELTSDNYKHQVKFFEPFKSFREKILSKIDEIFVSKPPRKRARRALHKDTFHSENKIIDKCSYNSKEGLQIALSCGRVRKIGTKYVENDTIVRVDIFKKQNKFYAIPIYAMDFALGILPNKIVITGKDKNNNPKQWQTIDESYEFCFSLYKNDLILLQKKNMQEPEFAYYNDFSISTSSICVEKHDNKFENLTSNQKLLFSNAKEGSVKVESLGIQNLKVFEKYIITPLGDKIKADFQPRENISLKTSKKYGLR

SEQ ID NO: 475 - protein, 1003 aa, Artificial Sequence
  Cas9
MIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALIPTPVGPDSYVIA

SEQ ID NO: 476 - protein, 1007 aa, Artificial Sequence
  Cas9
MKVLGFDIGINSIGWAFVENNELKDCGVRLFTKAENPKTKESLALPRRNARSSRVRLRRRRSRLLSLKHIISKEFGLHYEDYIALDGNLPKAYTGKIESIYKLRYEALSQAISKEDLARVILHIAKHRGYMNKNQKTSQDSEKGAILSAIKENSNKIKHYQTAGEYFYKELFENLRDGTKEFKNIRNKAMKNEKTGNMESTYYNTILASDLEKELKLILEKQQAYHNYSDTFIKEVLEIAFYQRPLKDFSHLVGSCTFYENEKRACKNSYSAWEFIALGKIINTLESIKKDTGEIFSNEIITQILKEVLDKGSLSYTKLRKMINLDEKVKFKGLKYDKEGVEKTNLIEFKKLKEFKKALGEHNLERKTLDEIATHITLTKDENQLKKQLEQYALSQNQIDALAELDFNDHINLSFKALYEILPLMEKGKRYDEACNELGLKAKTSNQKSEFLPAFCDSIFAQELTNPIVNRAISEYRKVLNRLLKKYGKMHKIHIELARDAGLSKEARNKIEKEQKENKDINDKAEKTCKEFGLKPNAKNILKIKLWREQGEICAYSGKKITIDDLKEDKALEVDHIYPYSRSYDDSYNNKVLVFIKENQLKLNQTPYEAFGSNQEKWSKIQVLAQKLPYKKKNRILDENFKNKDQIEFISRNLNDTRYATSLIAKYTKEYLEFLPLSDDEDISLKSGEKGSKTHVQTMNGMLTSVLRHAWGFSQKDRNNHLHHALDAIIIAYSTNSIIKAFSDFKKNQEILKAKLYAKKLTSEEYKNQSKFTGFEKYRSKILEKLDSIFVSKPPNKNTKGALHEQTFYSYQDILEEYKTQEGLKRALECGKVRKIGTKYVVNDRMVRLDIFKKDNKFYGIPIYTMDFALGVLPNKVVTIGTDKDKIKKEWKTIDETYEFCFSLYKGDLVLIQKKEMQESEFAYYNGFDISSASISLEKHDNKFENLTENQKLLFPKAKEGDVEVRGIGIQGLKVFKKYMVTPLGEIQETRTEARQNIQPRKKHGLR

SEQ ID NO: 477 - protein, 1010 aa, Artificial Sequence
  Cas9
MSDSSYVLGLDLGTNSIGWACVRLNKGKPDGLLAQGVRIFEAGLEIDAYGRGTPLNTERRNARQRRRLHDRRKRRILKVRRILQEAGMLPANKPDHKDAEWKMLLARNPYRLRAKALDEQIDLKEIGLCIYQFAHRRGFLSNSKILKKDDDRGKLKDATKAFAEDMEQKGARTWGEYLSHLDPHEQRIRTNYTLREWYTSEFDLIWEKQQSFYPHVLTDDLYKRVKEALFYQRPLKSQAHLLGQCELEPGRKRAPFALLMAQEFRLLQSLNHLRVVSSTGDERLLTDEERKQALALLRSRGNQKFTTLRKVLNLRGTKFNLERGGEKTIQGNNTAAALGNLFGEAWDHFSSEQKNQIVEDRLTIGDTDALIRRMKKTWGLDSVTAEMFSETELEDGYCGFSRKALEKLLPLLERGHALMEAVQAAYPDYQKNLPRTDTLPPLENLRNPIVQRTLSELRRVVNAIIKEYGKSDKIRIELARDMKQTAKNREKSWDRMRVRERQRKEAAKKILEETGNPAPRRHEIEKVLLAEECNWECPYTGKRICMNTLLGDAPQFDIEHIIPFSRSFDNSFSNKTLCDVNYNRNVKGNKTPYESASETEHEEMVCRVKRFTGDYKEIKLDRFNTRETDSRADFIEEFSTSQLNDTRYASRLAGEYLGKLYGSEWRKHIQIAKGGTTKYLRDAWDLNRILSDGGTKSRDDHRHHAVDAVVVALTTPQTVKALSDANQRAPEHRRYAFSDMPLPWETFRQDVEQAINSITVSHKVCRKANGQLHKETFYGLIKDRKTGDTRTVLRKPLHELTDKEIKRAEIVDSSIRKLIEQKLKDLDQPPKTAFKDRNNHPFIIDKNGNKRFIHKVRVYQDAKPVKIAENRHVKLGGNHHLEIFEVIDKKGNPTWKCEVISLFDTRQRVKEKRPVIVRQDQNGNPLKFSLSIGEAVQLDWNGGRETAVVQKMSKTPNTVEYVFRKHNDARKAADIPYKETITVKSDSALFASNLQKIVITPTGLIRRAND

SEQ ID NO: 478 - protein, 1010 aa, Artificial Sequence
  Cas9
MKNRNVIGIDVGTNSIGWALVEENENGLPQSLKAAGVRIFQEAVEAKTRTPKNHKRRQARLARRVLARRARRKQRLQNLLLKHGLLPGGVTDPVQREAAFTTLGDPYQLRAKGLNLPLGLHEFGRVLFQLGARRGFLSNRKTRYGHLNKLDELADLIEAEDAAPKTGDAEEGIIRKEIGELRQAMSAAGSRTLGEYLAGLAKEERKRCRHTERAMLEEEFERLWMVQARFHPELSDELKVQVHTVIFFQRPLKSNRASLGKCSLEPSRRKAARAWPEAQRFRLLQDLNNLEILDPRTGELRRLRDTERAILLNALEQQKSMTWNAVRKKLGLHQGEKFNLETGAKAETGLKGLQTLASLHAILQGWFDELGDKRDLLIEDLITIEDSAGLYRRLREHWGFDRETAFRLATLELEPGYASLSLKAIRKLLPHMGAGHRYSEARQQVGYGYETGQRDLQERLGEPPDPRNPVVDKALHELRRVINALIHRFGRPDVVRVELARDLKLAKRDKERLEKQNRENQRLNRKAEAALAELGLGQPSRDDLIKYRLWEESKGLCPYTGREIGLSTLFSPEVDVEHIIPYSRCLDDSYMNKTLCMTEENRMQKGNRTPWEAYGGDPARYEQILQCARYFPMAKRKRFLEQGSDFVDQFIQRQLNDTRYIAKLAKEYLAAVCTNVQVTKGGTTAMLRHHWGLNRLLGEDDGQKERGDHRHHALDAAVIAVTSRSLYQRLARIAHQRGHAPSQRGFYIDPPWQGYQADLAQTLAGIVVSHATNRKLTGALHEETAYGHIPHVGFVYRKTLNKDFKLGDIEAIYDPSLQELVKAHLEHHGNDPKRAFAEGIQCYHKDGHTPIKRVRIRAKQVSEKGTFSISDRAGRAYKHHKTGSNHHVEILRHRATGKIEPVYLTTKEATERARRGGEPVIQRDHGPEWEFIISLCINDMVRLGEGGQVAYFRVQKIEATNNRVTLRSHLAATLDDEDMKVTTSVPKLAVMPGFQKVLVTAVGEVLELHD

SEQ ID NO: 479 - protein, 1010 aa, Artificial Sequence
  Cas9
MKRMAAVGLMPADPTEAKALELLDPYALRAAGLDQALPLTHFGRALFHLNQRRGFKSNRKTDKGDNESGKIKDATKRLDEEMAIKNARTYGEFLHMRRTSATDPKNVPTVRTRLSIARRDNAEKEEAGYDFYPDRRHLAEEFDKLWKAQAGYSPDVLTDELRDEISVIIFHQRPLKTPEVGLCLFSGSHGVPKKDKRIPSAHPLNQRRILFETINNLRVAARGEPARGLTRDERDAIVHALDNKAHTKSLSGMSMKLKALGKVIKLRPEQSFTLQTANRETIACDPVRASLSHPDRFGPRWSMLDADAQWDVVQRIRAVQSEAEHDALVKWLMATHGLDRDHAESTAKAPLPEGYGRLGLTATKRILAALEADVIPYSDAVKACGWHHSDGRTGEVLTELPYYGQILDRHVIPGTYNESDDDVTRYGRITNPTVHIGLNQLRRLVNKIITVYGKPDEIVVELARDLKLSEDQKRDVQRDIKKNTDAAIARGAKLSEMGVPDTGANRMVLRLWESLGDDVMTRNCPYSGKRISATMLFDGSCDVDHILPYSRTLDDGFANRTLCLKEFNRQKTDKTPWEAWGDTPAWATIEANLKNLPANKAWRFAPDAMERFEGENDFTSRALKDAQYLSRIARTYLDALYDGADGKSHVWVVPGRLTEMLRRHWGLNSLLPDKDGAVKAKNRTDHRHHAIDAAVVAATDRSLIQRISKMARKDEVNGAEEVARSVPPPWEGFRTDIETQLDRIIISHRADHGRIDPAARKDGHDSTSGQLHNDTAYGLGEGNSVVSRKPLLSLKSNDIEVTTKGANIRDVDLQRHLERITRGLDGKALEAALAEFAATAKLPDGTDNPYYGLRRVRLEETLQQGARVEVKDRNGKPFKAYKGDSNHCYEIWRMPDGKVVPQVITTYEAHQIDVEKKPHPAAKRLLRIFKRDMVAIEQDDKAIIGYVQSMHVANGLFIAPHTEANADARSRDKSDSFRLIQMSAGPLVKANARRVYVDEMGRLRDPGAPS

SEQ ID NO: 480 - protein, 1012 aa, Artificial Sequence
  Cas9
MANMRYRLALDLGSTSLGWAMVRLDAQNETCAVIKAGVRIFSDGRNPKDGSSLAVSRREARAMRRRRDRLLKRKTRMMATLMKHGFFPQDEAARQALVNKEPFALRAKGLDHALLPEEFARALFHINQRRGFKSNRKTDKKETDSSALKKAIGQLREAMQASGCRTVGEWLCARHQQGLSVRARYRENRITKDDGKTKIEKSYDLYIDRAMIEAEFDALWAKQSELNPELFHETARAELKDCLLHQRPLKPVKPGRCTLLPDEERAPLALPSQQRFRIYQEVNNLRLLREGLNEEPLTLTQRDQLIQALETNPKRSFTQIQKLLGFSGQFNLQDDKRTELKGNSTSAMLSKKEFFGSQWLSFDETHQDEIVMQLVSEENEARLIAWLQAETGVDEITAERIANTPLAEGYGSLSAKALEKILPALRADVITYDKAVLAAGFDHHSHISHAATGEILPDLPYYGQYLQRHVGFGTGKPEDPAEKRYGKIANPTVHIGLNQVRTVVNALIKRYGHPSEVVVELARDLKQSQEQRKEEQAQQAKNQRRNERMRQDIAGLLNTSTERVRALDLQKMILWEELSFNVADRRCPYSGVQISAQMLFSDQVEIEHILPFSQTLDDSLNNKTVAMRQANRIKGNRTPAEAAADFAAQGWPVEDMLHRASLMPKGKRYRFAQDGMAQWLREDKGFLARALNDTRHLSRVAREYLSLVCPQGTRVIPGRMTAMLRAKFGLNDILGLNGEKNRNDHRHHAVDACVIAVTDQSMLQKFAKASASAREKQLNKLVESMPLPWDSYRDHVQRAVERIWVSHKPDHGHEGAMHNDTAYGLLGGGHVQVRKRMDGVRTRETAALKVIEFADRQAHPRHGLLPNGEPMPYKGYKGDSNYCMEIVRNDKGKWEGEVVSTFEAYQLVRQHGLARLRHPALSVSGRPLVMRLLRNDTLRVIHNGEQRTVRICKMTAEGVIALADTTESNVDARTRTKDLSYIFKTAGSLQKSKGRRVAISPSGEMKDPGFFD

SEQ ID NO: 481 - protein, 1016 aa, Artificial Sequence
  Cas9
MEVFVDVSARQLGIDLGIGTCGWALLAEDSLIALGTRTFDVPETDKERIPTNQIRRQARGMRRVIDRRRQRMNAVRRLLADHGLLADGGKLGLATVRLDPWQARAEGLDRLLSAGELAVALGHIAKHRGFRSNSKRDRGANAPKESSAMLGAIAQTGERLQHWRTVGEMFWKDEFYQTRRRNRDGDYSRTVQRLDLETEVHRLLAAQRRLGNPLATFDLEQSFIDVAFFQRPLADSDDKVGPCPFEPSEKRAARHSPSFERFRLLSRLAALRLSSGAGERPLSDAEFAAACADFGRLQGFSFKRLRQHLKLDPSIRFAGIAPDEEGKRDVVARSGEATPGSAALRHCLGDTVWDNMLGTRPALLDAIAAILTFRDDADRIAEGLAGLGIEEPILDALMDGVRNGSFGKFKGPGHISAKACRALLPHLARGRVYSDACADAGYDHSRQTETNLDDIRNPVARKALGEALKQIKIIIHTHGRPTAIHVEMARDIGKSADERDEIKKGIDKRNSEKDRARQQFHEMVGTPAAGAEDLLRFELWKEQNGWCLYTGREIPIDALVSSDNRIQVDHILPWSRSGDDSYINKTLCFTEANQHKKGMTPWEWLHDDPERWEKFARTVEGCKTMKGRKKRNLLLRDSSRLEKEFRSRNLNDTRYACRLLLGILKHTYPDIVVAARPGPLTDRLRRAWGLQSLKKHEDGTRKDDDRHHALDAAVVAATSQSMLQRLTTLFQKAEREGGRRDFVGLEPPWPGFRADLEAKLEGVVVSRAERRRARGAGHKDTIRAIGEGDAGPVVYERKPVAALTEKDLDRVKDPERNKVLIENLRQWIAAGKPKDPDKAPRSPKGDPMTKVKLVTTDDVRILVRGGTADRGDMARVDVFRQADPKGRWRFFLVPVYPHQVFDPTDWPQPPNRAVVAYKPEKEWTVMGPDHEFLWSLYPFSWIAVEKADGTRIEGYFRGMHRSTGAISISPHHSKSLASTGIGAKTLASFRKFAMDRMGNLSEIEREVRTWHGVACT

SEQ ID NO: 482 - protein, 1017 aa, Artificial Sequence
  Cas9
MRVDSLGRCLSDEEWARVIYHLCKHRGFHWISRAEAKQTEGDSKSEGGKVKQGLAGTAKLMDEKGYRSAAEMVLAEFPEAQRNKQGEYRKALSRELLAKELALLFARQRVFGNRHATDTLETAILGNSDKKSGLFWQQKPALAGADLLKMLGTCTFEKNEYRAPKASFTAERHVWLTRLNNLRIVTDGITRQLTEQERQLVLPLPYRQAGDLTYKQLGMALTKAGLLEAGCFKFIGLAYPTEAQKAEGKTKDPESATLVKIPAWQELRQTLNKASLNDEWEKLSGDALCGQPEIFDKIAWILSVYKDDDEVRTELAKLVLPNPEGLTEALLNIRFDKFHALSLKALRAIVPHMEKGLRYDEACVQAGYHHSQLHKIGEGEHKYLPPLYDGRDGDGRMIFAEDADIPRNPVVLRSLNQARKVVNAIIRRYGSPSAVHIEMARDLSRPFDERNKIKKDQDEYQARNQRDREQFIELFGHPPKGLEFEKWRLYREQNGQCAYSQKPLASSGDVAEIFLDGSTEIDHALPYSRSFDDSKNNKVLVLTRENRDKGNRTPYEYLGGAENSERWQRFFSFVESNKAYRLAKRTRLLRKDFGAKESEEFRERNLNDTRYVCRFFKNYVEQHLKLAEGSEAKRCVVVSGQLTNFLRTRWGLLKIRSDSDRHHALDAAVVAACSHSMVQRLSNYSRTRELEQVRDGFVNIETGEIVNPAMHQQLREHFPDPWPYFRHELEARLKIDSPALLREEMARLSSYTEEELAALKPLFVSRAPQRRNGGAAHKDTIYGQPEKLKKNGSVSQKVALASLALKDIDLLADPHRNAKLYGAIRERLEAHGGKGDKAFPATNPLRKPDKEGNPTGPIVRTVTKVIDKLSGIPVRGGIAKNDTMLRVDVFTKAGRFHLVPVYVHHRVTGLPNQAITRGKDENQWAIIDDTFEWRFSLYPNDLVQIRLKDETHLGYYASTDRSTSSISIWAHDRNQSVGKDGLIRSIGVTTAKDIEKFHVDTLGNVYPAPPEKRRGLA

SEQ ID NO: 483 - protein, 1021 aa, Artificial Sequence
  Cas9
MRRRRDRFKQRQAALLKHLAGVGLFPADEAARRELAGLDPYELRARALHEALPLNHIGRALFHLNQRRGFKSNRKTDRGKADDEGKIRLGVARLQEAMHEKGSATLGEFLHGRRAAATDPNQIPSVRTRLRAESGEGARGDGYDFYPDRRMLEDEFEAIWESQQVHHPAVLTDEIKQRFFEVIFYQRPLKQPEIGTCTLVAGERRLPKAHPLFQKRRLLEELNALRIVWPGVQAELLSREQRDLAYLKLKDKRAVRFESLRKALKLDPDARFNKESENRSELKGDEVAAELGAKSRFGGRWGHTAPADQWEIVSRIQALESDDDEAQFCVWLSERYGLDSEQARAVAAARLPQGFGRFGLTATTRLIKALQDEVIVYSEAVQKTGLGHHSDFRNGEVLAELPYYGIALERHIMPGTGDPGDSDEMRVGRVTNPTVHIGLNQLRRVVNRLIKRYGPPRQIAVELARELKLDDQHKREINGRNRQNREAAERRSQKLVDIGIADKGANRALLKLWEELNPDNALDRRCVYTGRQISIEMLFSGAVEVDHILPFAATLDDSNANKLLCLREANRNKRRRSPFEAFGQGADWEEIAARAARLPREKRWRFEPDAMARFDTEEKFLARQLVDTQYLSRLAREYLGVLFPDKGEGSGRVWVSPGRLTEMLRRSWGLNHLLPDHNLGGGADQPKNRRDHRHHAIDAIVVAVTDRHLLQAIAREAGQRGHEAANRMTADLPVPWPDFDRDVGQVIRQVVVSHRADHGTVSKAGAAKGQDSTAGRLHNDTAYGLTGQTDEKGNTIVVRRVPLTALKKPTSIEAVRDDELRKALSVWTRGYDGKAFEARLSRFPELGPLQFRGIRRVRVVEPLTVIPIRDSSGRVYKGYKGDSNYRYDVWELKDGKWVAEVVSMFDAHQSSWTSPVRRENPTARKVLSLQQNDIVAIEPEGKERELMRVAQLRQGGQITLAACHEAGDLKRRDAESNEVDPFKYFSPTAGGLKRVRARQVRVDELGRVLDPGSRDRERGAA

SEQ ID NO: 484 - protein, 1021 aa, Artificial Sequence
  Cas9
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 485 - protein, 1023 aa, Artificial Sequence
  Cas9
MKILGFDIGVASIGWAFVEGDEIRDCGVRIFTKAENPKTGESLALPRREARGVRRRLARRRVRLNTIKKIICKEFDLRLSDYIADDGELPKAYQTNKDTKSPYELRYKALNERLSKEELARVILHIAKHRGYGNKHAKDGDDKDSGKVKKAIGENKTLLEQKGYESVGEYCFREFFKSIKDKDGETHNIPSQNIRNKKGNYDRCVSQKQLEDELKLIFAKQRKLGFNKEFEDAILEVAFYQRPLKDFDDKIGDCIFFDNEKRAPKESISAIEFVALTRIINTLKYLSKTTGEVYEKEIINKIWQKILENGKMTYAELRKILALDSSVFFKDKDLDYTLGIKEAEKIKFIEFKKLIKFKKALGSFDGLSREILDNIAMQIAITKDRQRLLEKLEVFPLNKEQKENLSQLNFSKYIDLSLKALNQILPFMREGRRYDEAKDDAKLQEKAKNTKKEEFLPPLKEFDLNLTNPVVARALAEFRKVLNALLKKYGKVHKIHLEFARDMRLDFDERERLISIQNDNFNKRQLAEDFCKEHGLEPSNANILKIKLWQEQQWHCMYSGELIGIPDLKDPTKLQVDHIYPYSRSFDDSYTNKVLVRAEWNQEKGNHTPFEAFGGDKNKWDKIVALAEKLPPSKKLNRSEKSKKDKLLDEKFNDKELGFLARNIVDTGYIARLVAKYIDMYLEFLPLEENENTSLARGEKGSKKHIGIVNGRLTSEVRHNWGLDPKDRDNHLHHAIDAIVIAYMNDKRIKAFADFRRLKELKIKRYGREITEDEYQEKKKELSCAPFDDFRNRTLENIDKIFVSRPPRKRARGTLHEETFYSIDDKKLLKAYGGKEGMQRALSLGKIRQIGTKIVKNGTMVRVDIFKDKRGRFYGVPIYTMDFALGVLPNKAAVSGKDKNGLIKEWAEMDSGYEFCFSLFKDDLILVQRKEMQEPELCYFVSFDSSNAQIDVRSHNNHFSVLNENQKLLFKSATQAEVIGESIGIQNLKVFEKWHVSPLGEVRKAEFSPRGEAKLKTSKKRKK

SEQ ID NO: 486 - protein, 1023 aa, Artificial Sequence
  Cas9
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFESKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 487 - protein, 1024 aa, Artificial Sequence
  Cas9
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 488 - protein, 1025 aa, Artificial Sequence
  Cas9
MGGYMPQLMRYRLALDIGSTSIGWAMIRLSMQNEPIAIIRMGVRIFSDGRNPKDGSSLAVTRRVARQMRRRRDRLLKRKTRLLNALVQKKFFPEDADARKALVVLNPYELRKEGLYRQLSGPEFGRALFHISQRRGFLSNRKTDKKDNDSSVLKKAIVDLRQQLEVENCQTIGEWLFKQQQSGKSVRARLRGKTQKDKAYDFYIDRAMIAHEFDTLWVSQAKYDPLLFNEDARAILRDILLYQRPLKPVKPGRCTLIPDESRAPLALPLTQQARIYQELNHLRITTPALGAQALTVAQRNTIAALLEKSDVTFVKIAKALGLTSTTEFNLQDIKRDRLKGNATAIILARNQYFGRRWHDFNADLQNLIVDKLVNEGSETALIEWLKANTDVDESAAERVSGVTLPEGYGSLSVAALRRLLPALKEDVVVYSEAVKRAGFDSHSALSLIEQTGELYQELPYYGEVLQRHVGFGSGDPNDSPERRFGKIANPTVHIGLNELRKIINALIKRYGNPAEVVVELARDLKLSREKRKEIQEEQKQRQDRNEKRIKDACEILGIDPLVIDRGKRREISQKMQLWDELNPKDAANRRCPYTGDQISIEKLLSAEVEIEHILPFSKTLDDSLNNKTVAMRRANRDKGNRTPYEAFGESLNPDYDYDAILQRASLMPREKRKRFASDGYQQWLRDDKDFLSRALNDTAYLSRIAKEYLTLICPPNSVRAIPGRMTAQLRAMFGLNRLLSEGGIKNREDHRHHAIDAAVIGVTDQGLLQKFSRASARTRELQLSRLVDDMPLPWDTYREHVTRALEHLVVSHKPDHGYQGKMHEDTAWGLRDNGQVTRRVRSEDGGPRQRLLENKNVVKINSTRDFSRHGIDEQGQVNAYKGYVGGSNYCIEIWIDEKGKWNSDVVSTFQAYQIVRELGEKAAWQKLRNPLLSLSAKPLVMRLIIDDVVKMQIAGQNKIMRVVKIAQNGQIFFAEHNEANVDARDKDKNNPFKYISKTAGSLQKAGGIHMAISPIGDARPVRYGR

SEQ ID NO: 489 - protein, 1027 aa, Artificial Sequence
  Cas9
MKYTLGLDVGTNSIGWAVLELNTNGEPQRIEKLGSRIFTDGRHPKDGTTLASKRRQKRHERRRRDRLHQRKKLVLNQLVSMGLFPQSEQEQQDLKSLDVLTLRANGVSKQLSAYELGRVFYYLNLKRGFKSNRKGGSEEDKANKISERIKKLQEQLKENDFKTVGQYLHDRYIKGLSTKATIENDFHLLRQLIEDEFDFIVETQSKFFPEISDEQWNTLRNRMFHQRPLKPVETGTCSLFEDKKRTYKYMPSFEEYRFLTELFNLSYQDENFHSHSLSSEQIFKVFHELKNTREATYTKIKKLLKLPSDLSFSIERSKSKDKIKISTTNHFFSKSLLFAEEWASLDLKLKDEVAEIYFSDMSVEEIKKGLLQLKIDSEIIENLLEEKVPNVQEATCSYSKEALQKIVSLILEEERHPTLIVDDLFKNEKEETSLIDRLDYYGASIPDSMQPIPQHIKDNNLTLNEDEKRYGKIANPTVHAALNQIRQVVNDLIEQYGKPTNIHIEFARDLKKSKEERDFDNRKKKKNEELNEQVRDFIEKHNQKPSAFNFERVKLWFELDAMNNQVCAYSGKTISARMVLSDEVQVDHILPFSRTLDDSLANKVLVLASENVKKRNRTPYEAFGQDTEKWASIQELAKRLPYHKQWRFAEDAIKKFEEKDQFLQRHLNDTRYISKIAKKYLGSITDPYKIVASRGQMTSIIRGKLGLNQFIQKPDGTKNREDHRHHAIDALTVALTSRSYLKRISDASARNQDPNRIPIPEPWKGFIKDADVKFNEIIVSHKVDHGKNGPFMEETCFGLIKNPNKYEEENDFKLITTKSLDSVKDPSTIRSQSLQNLAEKSGVISLAKSGVKKLRVYDVTKENPADIGLIESGLAKITHGKDKQHVKHYQKGDINYLAIWCLPQNITLKSDNHKKRKTDYIFTAIKTFDLNSKNPNDLRPHPAAKLVTKVYKGDTVALEVNNQLNYYIVKSIRAANKKLYFLKINQSSELANETQFIPAYTKLVDYKFRKVSVSPTGVITDNGPLLK

SEQ ID NO: 490 - protein, 1029 aa, Artificial Sequence
  Cas9
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 491 - protein, 1029 aa, Artificial Sequence
  Cas9
MKYRLALDLGSTSLGWAIVQLNAKDEPCAIVRAGVRIFPDGRNPKDGSSLAVTRRNARAMRRRRDRLLKRKARMQRLLIEHDLFPADEAARKALETLNPYELRAKGLDAALTPAEFARALFHLNQRRGFKSNRRTDRKDNDSGALKAAIGGLRAQLDTAGADGRARTVGELLWRRMSDPNVLTVRARYREQRITKDDGKTRVDKSYDLYVDRAMVEAEFDALWAKQAELSPTQFGEAARATLKDCLLHQRNLRPVRPGRCTLEPDEPRAPLALPSQQRFRILQEVNHLRLLGGRLLEESLSVEQRDKLVAALEDGSKSFKTAIPKLLGLPGTVQFNLADAKRTELKGNATSMLLGKKDFFGPAWHGFSEARQDEIVMRIQEEESEARLVDWLATSTGVDEAHALKIANAALPEGYGSLSAKALAKILPAMRAEVITYDKAVLAAGYDHHSHISHAASTGEILPELPYYGEYLQRHVGFGTGELNDTPEKRFGRIANPTVHIGLNQVRVVVNALIKRYGHPTEVIVEVARDLKQSQDQRRETQEQQAKNQKRNERLRKDAAAILGIADERVRLADIQKLILWEELSFDIADRRCPYSGVQLSAAMVLSEQVEIEHILPFSMTLDDSLNNKTVAMRLVNRLKGNRTPWDAREAFAGQGWDYDGILMRAERMPRAKRQRFAPDGLEKWLKEDKDFLARALNDTRHLSRVAREYLSLVCPASTRVIPGQMTAMLRAKFGLNDILGLNGEKNRNDHRHHAVDACVVAVTDQGLLQRFAQASADARGKGLDRLVETMPDPWDSYREHVQRAVNSIWVSHKPDHGFEGAMHEDTTYRPPHLDPKNMWRTRGIGGGKPNEKEADSKAMVGFTGPEHLQRHHRDKAGQQLPYKGYVASPKFCMDIVRNDKGRWEGEVVSTFEAYRLVSEFGRDAALAHIQSKSRSISGKPLVMRLQGGDMVRFDDDEGRPVVLRVVNMTGNGQIFFAPHNEANGDARNRDKQDQFVYLSKYAGSLQKARGRRVTVSPAGELRDPGFKE

SEQ ID NO: 492 - protein, 1029 aa, Artificial Sequence
  Cas9
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGALKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGIVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 493 - protein, 1031 aa, Artificial Sequence
  Cas9
MPAIYRLALDLGSTSLGWAVLRLEPAALEPIAIIKAGVRIFSDGRNPKDGASLAVTRRAARAMRRRRDRLLKRKARMQDKLVKHGFFPSDMDERKALERLDPYALRAKGLREALTPGEFARALFHINQRRGFKSNRKTDKKDNDSGALKKAISHLRQQMEAGGHRTVGDHLWSRLQQGLGVRARYRETPFTNDEGKKRIDKSYDLYIDRAMIEQEFDALWAAQAAFNPALFHEVARADLKDTLLHQRRLRPVKPGRCTLLPEEERAPLALPSTQRFRIYQEVNHLRLLGEDLREVALTLAQRDAVANALESKARLTFEQIRKLLKLSGSVQFNLEDAKRTELKGNATSAALARKELFGAAWGGFGEALQDEIVWQLVTEEGEGALIAWLQAHTGVDEARAQAIADASLPEGYGSLSRKALARIVPALRAGVVTYDKAVQAAGFDHHSQLGFEYDAGEVEDWVHPDTGEIRPVFKQLPYYGKPLQRHVAFGSGKPEDPDERRYGKIANPTVHIGLNQVRTVVNALIRRYGRPTEVVIELARDLKQSREQKVEAQRKQAENQRRNARIRKSIAEVLGIGEEQVRGADIQKWICWEELSFDVAERRCPYSGVQISARMLLSDEVEVEHILPFSKTLDDSLNNRTVAMRQANRIKRNRTPWTARDDFEAQGWSYEGILQRAERMPLRKRYRFAPDGYERWLGDDKDFLARALNDTRYLSRVAAEYLRLVCPGSGTRVIPGQMTARLRGKFGLNGVLGPDGEKNRNDHRHHAVDACVIGVTDQGLMQRFANASAQAREDGLTRLVDDMPRPWPTYRAHVERAVRHIWVSHRPDHGFEGAMMEETSYGIGKDGSIKQRRKADGSPGREITNLIRIHEATQPQRHGAGPDGQPLPYKGYVGGSNYCIEITRNDKGKWEGEVISTFRAYGIVRTSGLGQLRHPRVGQNGRELVMRLVIGDSVRLEIDGIERTMRIVKISGSNGQIFMAPIHEANVDARNSDKQDAFAYTSKYAGSLQKTKARFVTISPIGEVRDLGFKG

SEQ ID NO: 494 - protein, 1032 aa, Artificial Sequence
  Cas9
MKKRILGLDIGIASVGWALVEFDDEFQDNKKKGTIIKSGVRIFTRAETPKERESLAKPRREARSQRRRIRRRVERLNSIRELFVKNGVVEEWSVSKKNPNNIYITLNQIKTPWQLRMESLDRKLTNEQFAVVLTHLAKHRGYKSLRKDDKAGKVLEAISQNKKRLNDSDYRTLGEMFCKNESYKEHKRNKGGEYINSVARELIEEEVEKIFVKQREKGNNFADVNTEREYLKIAFSQKPAGSISKMVGFCTFENGEKRAPRDSYSAELFKVLCTINNTTFTDMKTGEIRSFSKEEIGKTLETVKNVKDVKYAKIRKDLGLEDSVKFSGVDYRENAKSKGEGEIFVSMKTYHEIKSKIEKLSKEKWDNLKGNTELLDSIVNIIANLKDDESIKKEFQKLKIDEDIIDVLLNFEFKKFINLSFKALRKIIPFQFQGQKYITASTSAGYSLKQEGIKNKLVPPAKENINVAVVARAFAQTRKVINAVIRKYGQFDQINIELATELKNSKFDRSKIEEGQKKFQSQKDKIFKEVQELRGGMTPSSSLLLKYRLWREQDERCVYSGRKISFEDLLDTGFLDIDHIIPYSKSMDDSFNNKVLCLAEENRNKKNDIPFNYYQRIDRDWNLLISIITSMKNMKIAKKSRLLKQELSDIEGFIERNINDTRYATRYIKDFLENNLEFKENEFIKVKVQARSGGLTSVLSYNWGMSKDREESYFHHAKDAIIVACSTQGMVQYISKISQQYENDKDKMKKIKDKTENCIPKPWDSFRADVEESIEGIFVSFAPRHKVTGSAHKETIYSKKHLEKERYVTVKKSLDKIKLSDLENIPCNENCGIIRVLKERLEKFKNDSLKAFADPVHMPTKCPNKKGPVIRSVKIKESNKTGIEVRKGLAERGEMVRVDVFIKDKKYYLVPIYVSDFKNKDLPNKAIAALKLENEWIMIDKTYSFKFSLFKDDLIKIKKKKEEIFGYFGGVHRSTGTIKIKSRHKPKEIDEGIGSRCLLDFRKFQVDVLGNYTEVKHEKRMPAYITRKDKKH

SEQ ID NO: 495 - protein, 1034 aa, Artificial Sequence
  Cas9
MKILGFDIGIASIGWAFVENGELRDCGVRIFTKAENPKTGDSLAMPRREARSVRRRLARRKGRLETLKRLLAKEWDLCYEDYIAADGELPKAFMGKNLTNPYVLRYEALQRLLGKEELARVILHIAKHRGYGNKNAKITKSEESKREQGKILSALATNASVIARYRTVGEYFYKEFCEVIKNPQGLNTNENCTQPKVRVLKPIRNKGGEYTNCILQEDLQRELRCIFEHQKGFGFPITQEFQDKILKIAFYQRSLKDFSHLVGKCTFYPDEPRAPKFSLSAIEFITKAKTINLLVGIVKESGEVWDKEQWRERLDSVFSAVCERGNLTFAQMRKILKIDERIQFKEVDYTAKNPENKKFVEFKNLKKFCEILGAIVGDRALADSIARDMTLIKDEEELAQKLRGYGKFSQEQITQLGALNFSHHINLSLKALSEILPFMREGMRYDEACQEAKLQAKHNDKKSKFLPPFCGSIYADELTNPVVHRAIAEYRKILNALIAKYGNVHKIHIELTRDVGKNFQEREKYKKEIESNYKARVQAMQECEKLGLTLSEGNILKLRLFMEQNERCVYSGRKITLANLKEQGALEIDHILPYSRSSDDSYMNKVLVFTNENQNKGNKTPYEAFGGDSQKWGEIESLALRSGYPKKKAKRILDKGFGDREAGFKSRNIVDSGYIARLIANYTKEYLKFLPLDSHENTALIAGEKDSKIHVEAVKGMLTATMRHFWGLGSKNRYEHTHHAIDAIIIAYINAAMIQRFSQFRQNQESLKARFYAKELAKEEFKTQRAFFEPFSGFREQVLAKVGQIFVSRPPRKRARGALHEETFYSIDDKKLSETYGGKEGVQRALSLGKIRQIGTKIVANGPMVRVDIFKHKKSGRFYAVPIYTMDFALGILPNKAVVSGKDNDRIIKDWLEMDSNYEFCFSLFKDDVIEVQKKDMEKPELAYFVSLNTSSASIALVKHDNKFETLTSNQAKLFSNAKENNVIAESLGIQNLKVFKKYKVSPLGEIKEAKYEPRQPIALKTSPKKHRKQNNAQ

SEQ ID NO: 496 - protein, 1035 aa, Artificial Sequence
  Cas9
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 497 - protein, 1035 aa, Artificial Sequence
  Cas9
MEQLNYILGLDIGIASVGWAVVEIDHNEDPIRLIDVGVRTFNKAEVAKTGESLSLIRRLARGSRRLVRRKKMRLLTAKRLLKSEGILSDLDFNKGAILNLPNNCWELRVKGLDKKLSDKEWAAVLLHIIKHRGYLSQRKHDRKTDDKELGALLSGVSKNHSLLEEGEFRTAAELAINVFCNSKGHIRNQWGDYSHTFSRLDLQKEIKQLFVSQRELGNPYTSSSFEENIISLLMKQKEAISGNDILKMLGKCTYEKNEYKAAKNTYSAERFVWLTKLNNLRIVDDGVERALNSSERKLLIDEPYKKAKLTYAQVRKILELPDSAVFKGVRYFADNAESSTLMEMKFWHSIRKALESNNLKDEWLVLKTKPELLDEIGTGFSIYKTDDDITSYLSNKLDKKVLDILLVEVSFDKFIELSLKCLRKIIPLMEKGYRYDEAYKYIYGEVNIEYNLNDIKNPVVLRSFSQSRKVINAVIRLYGSPARIHIETARDIGKSFKERKAIEKQQEKNRLEKVRAAEHFKQLFPNYVGEPKAKDILKVRLYEQQQGKCLYSGKILDIKRLMEHGYVEIDHALPFSRTWDDSFNNKVLVLANENQNKGNKTPYEWFNGKDNSDSWKRFLALVNNSGFSAVKKQHILMKEIDEEGFKQRNLNDTRYITRFLCNWVENNIPLLGKGVKRVFAPQGKITALLRSNWGIRKVREDNDRHHAIDAIVVACTTVSIQQRITNYVKNSEINRKIKRQNYLKFPEPWKFFREDISIRVFSNNPIEELKQQLSDRPEANHQFVTPLFVSRAPVRKMTGQGHEDTIRSAKRISEGISVLRVPLTKLNDKSLELMVNREREKELYDALKQRLLEFKNDPEKAFAEPFYKKGGQQVKTVRIERVQKNGVLVNNNTGIADNGNIVRVDVFLKKKKYFLVPIYSWQVAKGILPNKAIVAHKNECDWADMDGSAQFLFSLYTNDLIEVVLKDSTILGYFSSIDRATAAIIIKEPDMEKSKGKEGIHRVGVKTARSFIKYNVDVLGKNISRCRKAKRLPVR

SEQ ID NO: 498 - protein, 1035 aa, Artificial Sequence
  Cas9
MLRKMHYRLALDLGSTSLGWAMIRLNAGNEPCAVIKAGVRIFSNGRNPKDGSSLAVTRREARAMRRRRDRLLKRKARMIQTLIEYGFFPAKEDQRKALEIMNPFALRAKGLNEALTPAEFARALFHINQRRGFKSNRKTDKKDNDSGALKTAINKLRETLKTENCRTVGEWLNKRDVAGLTVRARYHQDKTIKEDGKSKINKYYDLYIDRAMIEHEFDELWKKQAELNPTLFTEAARADLKDVLLHQRALKPVKPGRCTFMPDEERAPLALPSTQRFRMYQEVNNLRILRDGLKEESLTLNQRDDLIAALEENNKRTFTQIKKLLGLGGVVKFNFEDPKREELKGNTTSAILGKDEHFGSVWFKFDEAKQDAIVMQLFKEENEAKLLRWLQNETGIDEKRAETIANVGLPEGYGSLCALALARILPELRRDVVPYSDAAKAAGFHHSDTSNNQEVPGLTFPIELVVTETGEIKTKHIFHELPYYGEYLQRHVGFGSGKPEDSAEKRYGKIANPTVHIGLNQVRLVVNTLIKRYGHPSEVIVEVARDLKQSKDLRDEEGKRQAENQKRNKRIRTAIAGVLQTSEERVRRDDIEKMILWEELSFDPADRRCPYSGVQISAAMLLSDEVEIEHILPFSQTLDDSLNNKTVALRQANRVKGNRTPWEAFGAQSTAGFDYATILARAEHMPKGKRYRFAEDGYQRWLKDDAGFLPRALNDTRHMSKVAREYMSLICPNTRVIPGRMTAMLRGKFGLNDVLGLNGEKNRNDHRHHAVDACVIAVTDQGLLQRFAKASASAREQQLNRLVENMPLPWESYREHVERAIDAIWVSHKPDHSHEGAMHNDTAYGLLGDGKVSIHKMVEGKRERIEESLKVIAFTNAKANDRHGLLDNGEPRPYKGYKGDSNYCIEIIRNEKGKWEGEVISTFDAYQLVREHGVARLRHPTLSVSGKPLVMRLMKDETIRMVTNEKPITARVCWVRSDTRIAFASTSEANVDARDRDKNDSFSYIVKTASVLQKLQARRISISPTGELRDPGFKE

SEQ ID NO: 499 - protein, 1035 aa, Artificial Sequence
  Cas9
MEQLNYILGLDIGIASVGWAVVEIDHNEDPIRLIDVGVRTFNKAEVAKTGESLSLIRRLARGSRRLVRRKKMRLLTAKRLLKSEGILSDLDFNKGAILNLPNNCWELRVKGLDKKLSDKEWAAVLLHIIKHRGYLSQRKHDRKTDDKELGALLSGVSKNHSLLEEGEFRTAAELAINVFCNSKGHIRNQWGDYSHTFSRLDLQKEIKQLFVSQRELGNPYTSSSFEENIISLLMKQKEAISGNDILKMLGKCTYEKNEYKAAKNTYSAERFVWLTKLNNLRIVDDGVERALNSSERKLLIDEPYKKAKLTYAQVRKILELPDSAVFKGVRYFADNAESSTLMEMKFWHSIRKALESNNLKDEWLVLKTKPELLDEIGTGFSIYKTDDDITSYLSNKLDKKVLDILLVEVSFDKFIELSLKCLRKIIPLMEKGYRYDEAYKYIYGEVNIEYNLNDIKNPVVLRSFSQSRKVINAVIRLYGSPARIHIETARDIGKSFKERKAIEKQQEKNRLEKVRAAEHFKQLFPNYVGEPKAKDILKVRLYEQQQGKCLYSGKILDIKRLMEHGYVEIDHALPFSRTWDDSFNNKVLVLANENQNKGNKTPYEWFNGKDNSDSWKRFLALVNNSGFSAVKKQHILMKEIDEEGFKQRNLNDTRYITRFLCNWVENNIPLLGKGVKRVFAPQGKITALLRSNWGIRKVREDNDRHHAIDAIVVACTTVSIQQRITNYVKNSEINRKIKRQNYLKFPEPWKFFREDISIRVFSNNPIEELKQQLSDRPEANHQFVTPLFVSRAPVRKMTGQGHEDTIRSAKRISEGISVLRVPLTKLNDKSLELMVNREREKELYDALKQRLLEFKNDPEKAFAEPFYKKGGQQVKTVRIERVQKNGVLVNNNTGIADNGNIVRVDVFLKKKKYFLVPIYSWQVAKGILPNKAIVAHKNECDWADMDGSAQFLFSLYTNDLIEVVLKDSTILGYFSSIDRATAALIIKEPDMEKSKGKEGIHRVGVKTARSFIKYNVDVLGKNISRCRKAKRLPVR

SEQ ID NO: 500 - protein, 1036 aa, Artificial Sequence
  Cas9
MRIFGFDIGITSIGWAYVESNELKDCGVRIFTKAENPKNGKSLALPRREARGARRRLARRKARLNAIKRLLCKEFGLNVSDYFANDGELPKAYETTKDTKSPYELRSLALEQKLEPKELARVILHIAKHRGYGNKHAKTGSDKDSGKVLSAIKVNETAMKDKYQSVGEYLYKEFYQKLRLESEKKGNNITKEFKNVRNKGENYEHCVAQEQVRAELELIFAKQKDFGATFSENFESQIIETAFYQRDLKSFEDKVGKCVFYENENRAPKDSLSAMEFVALTRIINTLKNLEEKSKNLGIGEVYGKDKIQEILKIVLDKGEMSYKKLREILHLDEHILFAKDSKLDYTQGVQEAEKAKFIELKNLKAFKKAMGGDFSNFAREELDKIATDITLVKSKENLAKKLQNYSALSKEQVEALSNLSFAKHIDLSLKALEQILPFMRGDKTGKCLRYDEAVKKAELQEHRKHKQKGEFLIPLKDYEPYLANPVVARALSEYRKVLNALLRKYGKVHKIHLEFTREAKLSAKERQKYEKEQKEHFEANQRAIQQCEILGLPINGTNILKMKLWLEQGECCAYSGEKITREHLLDSNALQVDHIYPYSRSFDDSYMNKVLVFAKENQDKGNKTPFEAFGGDKEKWDRILSLSAKLPKQKQRRISNTNFKDKEGGFLARNLNDTGYIAKLASQWTKDCLEFEDLRENEVTIAGEKGSSVHIEVVSGQLTSMLRHYWGLGNKDRNNHLHHAVDAVILAYTNNAMIKAFANFRKNQEENKKKFYAKQIAESEYKAKKAFFEPCKNFRQRVEEKIKEIFVSKPPRKRVRGALHQETFYPFEKLCNDKEYSEKLKMDYGGEKGMQKAIALGKIRQIGTKIVSNGAMVRVDIFKDKKGKFYAVPIYTMDFALGILPNKAVAIGKDKDGVIKDWIEMDSNYDFCFSLFKDDLILVQKKEMERAELCYFVSFGSTNAQINVEKHNNKFEGLSENEKILYSNATQKEVAGKSIGIQNLKTFEKYQVSPLGEVQKAEFEPHQEIKLKSSPKRKD

SEQ ID NO: 501 - protein, 1036 aa, Artificial Sequence
  Cas9
MLHKMHYRLALDLGSTSLGWAMIRLDADNQPCAVIKAGVRIFSNGRNPKDGSSLAVTRREARAMRRRRDRLLKRKARMMRTLIEYGFFPAEAAQRKALETINPFALRAKGLDEALTPAEFGRALFHINQRRGFKSNRKTDKKDNDSGALKTAIGKVRATIEAEGCRTVGEWLHKRDVAGLTVRARYHQDKVIKEDGKTKIDKYYDLYIDRAMIEQEFDELWKKQAELNPALFTEAARADLKDVLLHQRPLKPVKSGRCTFMPDEERAPLALPSTQRFRMYQEVNNLRILRDGLKEEPLTLKQRDDLIAALEKNSKHSFTQIKTLLGVGGAVQFNFEDLKRQELKGNTTSAILSNDKHFGKAWFTFDEAKQDAIVLQLVKEENEAKLVRWLQDETGIDEKRAEAIANVGLPEGYGSLCAKALARILPELRRDVMTYDKAVQAAGFEHHSRLGSNTEIPGLTFKIESIDQDSGEVKQFHIHKVLPYYGEYLQRHVGFGSGEPEDPAEKRYGKIANPTVHIGLNQIRLVVNALLKRYGHPSEVIVELARDLKQSKDQRDEESKRQAENQKRNKRLRDAIAGTLKISEERVRRDDIQKMILWEELSFDPADRRCPYSGAQISATMLLSDEVEVEHILPFSQTLDDSLNNKTVALRQANRIKGNRTPWDAFGAQAVAGFDYESILVRAEGMPKAKRYRFAENGYQRWLKDDASFLARALNDTRHMSKVAFEYLKLICPNTRVIPGRMTAMLRAKFGLNDVLGLNGEKNRNDHRHHAVDACVIAVTDQGLLQRFAKASASAREQQLNRLVENMPLPWGSYREHVQRAINAIWISHKPDHSHEGAMHNDTAYGLRGDGKVSFHKMVEGVRTHSEDNLKVIEISNAKATDRHGLLPNGEPRPYKGYKGDSNYCIEIVRNEKGKWEGEVISTFEAYQLVREHGIARLRHSTLSVSGKLLVMRLMIDDVVRLIIDEQTRTMRIATLSGNGQIFMADTSEANVDARNRSKEETFAYVSKMAGSLQKANARRINISPIGELRDPGFKE

SEQ ID NO: 502 - protein, 1037 aa, Artificial Sequence
  Cas9
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 503 - protein, 1038 aa, Artificial Sequence
  Cas9
MAKQVRYRLSLDLGSTSLGWAIFRLDADAHPTAIIKAGVRIFSDGRNAKDGSSLAVTRRAARSMRRRRDRLLRRKTRMLDALLEYGFFPQDAAQRKALERLNPYALRAEGLARPLTPGEFARAIFHLNQRRGFKSNRKTDKNDNDSGALKTATSQLRQDIQASGCRTVGEWLWTQRLQKKPEGVPHQGVRARYRETPHINSEGKKRIEKKYDLYIDRSMIEAEFDALWSAQATFNPVVFHATAHEKLKDILLYQRPLRPVKPGRCTLLPEEERAPLALPSTQRFRIYQELNNLRLLVDQLNEQPLTLAQRDTIATLMEGRAKISFDQIRKALKLGSMTKFNLEDDKRNELKGNATGSQLAKKEFFGPAWHQFDEALQDDIVWHLLSEENESALISWLQDRTGIDAATAQAVSNASLPEGYGSLSRKALEVILPRLRSEVITYDKAVQAAGFSHHSQLGFEYDPDDVEDWIDHATGEVKPIFKRLPYYGKALQRHVAFGSGKPEDSQEKRYGKIANPTVHIGLNQVRVVANALIARYGRPTEIIIELARDLKQSREQRQQDQRRQADNQKRNARIRNSIAQALGIAEARVRREDIQKWILWEELDPGDAMHRCCPYSGVPISASMLLSEQVEIEHILPFSMTLDDSLNNRTVSLRQANRIKRNRSPWDAREDFEAQGWHYDGILQRAGLMPVQKRYRFAADGYQRWLRDDQDFLARALNDTRYLSRIAAEYLRLVCPQGTRVIPGQLTALLRRRFGLNDILGLEGEKNRNDHRHHAVDACVIGITDHGLMQRFARASAQAREQGLTRLAEEMPLPWPTYRDHVDRAVSLIWVSHKPDHGHEGAMMEETAYGLMKDGTIRQRHKADGTKGREVANVIRIAEPAQPTRHGVDDQGRPLPYKGYIGGSNYCIEITRGAQGKWEGTVISTSDAYGIVRARGIAGLRNTSQGQNGHPLVMRLVIGDSLRLRINDALQTMRVTKISGNGQVFMAGVHEANVDARNRDKSQAFALVSKMAGSLQAAQARQATISPIGEIRDPGFPG

SEQ ID NO: 504 - protein, 1039 aa, Artificial Sequence
  Cas9
MKKRILGLDIGIASVGWALIEFDDEFQDNKKKGTIIKSGVRIFTRAETPKEREPLAKPRREARSQRRRISCRVERLNFVRELFVKNGLVAKESVNKNNPNNIYITLNQIKTPWQLRMEALDRKLTNEEFAVVLTHLAKHRGYKSLRKTDSKDNKTGEMLKAINQNKERLDNSDYRTLGEMFCKHESYKEHKRNKDGEYINSVTRELIEEEAEKIFAKQRKEGNNFADVDIEREYLKIAFSQKPTGSINKMVGFCTFENGEKRAPRDSYSAELFKVLNTINNTTITDMKTGETRNFTGAEIKKIIEIIKDTKGITYVKIKKELKLGSSQFSGVDYRENAKSKGEGEIFVSMKTYHEIKSKIEKLSKEKWNKLKENTELLDSIVNIIANFKDDESIKKEFQKLKIDEDIIDVLLNFEFKKFINLSFKALRKIIPFQFQGQKYITASMSVGYSLKQEGIKNKFLRVPSQEENVNVPVVARAFAQTRKVINAVIREYGQFDQINIELATDLKNSKFDRSKIEKGQKEFQSQKDKVFQEVQDLTGEIIPSSSLLLKYRLWREQDERCIYSGRKISRKDLLDTGFLDIDHIIPYSKSMDDGFNNKVLCLAEENRNKKNDIPFNYYQRIGRDWNFLISIIASMKNMKYVKKKRLLKQELSDIEIESFIERNINDTRYATRYIKNFLENNLEFKENEFIKAKVQARHGGLTSVLRYNWGISKNREESYLHHAKDAITVACSTQGMVQYISNISQKYENGKYKMKQIKERTENRIPKPWDSFKDDVERSINDIFVSFAPRHKVTGSAHKETIYSKKHLEKGYVTIKKSLDKIKLSDLKNIPCDENCDIIRVLKERLEKFNDDSLKAFADPVHMPTKCSNKKGPIIRSVKIKENNKTGIEVRKGLVERGDMVRVDVFIKDKKYYLVPIYVSDFKNKDLPNKAIVSSKSENEWIMIDKTYSFKFSLFKDDLIKIKNKKGEIFGYLGGVHRLTGGINIKSCYKPKEKDGNIGSKCLLDFRKFQVGILGDYNEVKHEKRMPAYINTKKDKEH

SEQ ID NO: 505 - protein, 1040 aa, Artificial Sequence
  Cas9
MDRRDARAMRRRRDRFQQRQRALLKYLVADGLFPEDEGERKALAALDPYALRARALDEALSLHELGRALFHLNQRRGFKSNRKADRKADDDAGKIAIGVDRAREAMAENGARTYGEWLHRRRASATDANAIPPVRTRLRPESGEDAKGDGYDFYPGRDLLEEEFAAIWEAQAAHHPDVLTDDVYERLFEIVFYQRPLKAPQIGMCTLIAGDRRLPKAHPLFQRRRLLEELNALMIVRPGEVAQRLTREERDTLFLKLKDRNKVSFESLRKTLKLDPDARFNKESENRTELKGDEVAAAMGSKTRFGNRWVHLSIEEQWAVIERLGDVESDAEDAAFRAWLAERYELTPEQTRAVTNAPLPQGYGRFGETATRKLIDALRDGEKDGRVLVYSEAVTAAGLGHHSDRRTGEVFEDEEGRPQLPYYGVALERHIMPGTGDPSDSDEMRVGRLTNPTVHIGLNQLRRIVNRLIRAYGPPAEIAIELARELKLTDEDKKRINKENNSNRLDAERRSEKLLAIGKPDTGANRALLKLWEELNPANVLDRRCIYSGVQISIDMLFSAAVEVDHILPFTATLDDSNGNKIVCTREANREKRKRSPYEAWGHSARWEEIAARAAQLPRNKRWRFEPDAMEKFKDDGGFQARHLIDTQYLARLSREYLATLYPDKGEGSGHIWVSPGRLTEMVRRKLGLNDLLPDHNFGGGADQAKNRLDHRHHAIDAVVVAIVDRGMLNRIARASGQEGAEGRERIIIPEPWEGFRDDLRTAVNAITVSHRTDHGTASKAGLPKGKDATAGRLHNDTAYGFTGESDAKGNSIVVRRVPLSSFKKLADIDRVRDPELKAALYQHLDGLEGKAFEKAIGEFGSREWHPYGGVRRVRVTEPLSVIPIRDRNGHIYKGYKGDSNYRYDVWELPGGKWVNEVVSMFDAHQPGWQSAIRAANPTARKVLSLHRDDVLAIERNGAERELVRVVKFSEKQFAVAPPNEGGALKARDADKGDPFKYSYPSPNTLKALRARQVRIDELGRVLDPGFPARTKQRKTRKPN

SEQ ID NO: 506 - protein, 1043 aa, Artificial Sequence
  Cas9
MQRDNPLVYRLALDLGSTSLGWAVFRLDAEGSPLAIIKAGARIFSDGRNPKDGSSLAVTRRAARAMRRRRDRLLKRKARMLGALERHGFFPQDESARKVLETLNPFLLRAQGLEVALKPEEFGRALFHLNQRRGFQSNRKTDRKDSDSGALKQAIGTLRAQMHESGCRTVGEWFWKVRMEHKPEGVKGQGVRARYRETPFTTDEGKKRIDKRYDLYVDRAMVAQEFDALWAAQAAFNPALFNEAARAELRDILLHQRKLRPVQPGRCTLVPEEPRALLALSSTQRFRIYQEVNHLRVLHDELREETLTLAQRDQIVALLEKQAKVTFTAMRKALGFSALFNLEDAKRDGLKGNATAAALSKKDLFGPLWAGFGTALQDEIVTQLMTEESEPRLIAWLQEHTGVDEARAQAIANTGLPEGYGSLGRTALARIVPELQRDVITYDKAVQAAGFAHHSDLGFSFEHGADEVERIGERTIASTGEIKPVFAFKQLPYYGRALQRHVAFAKDNPRNDEERYGKIANPTVHIGLNQVRVVVNALMRRYGRPAEVVIELARDLKQSREQKLEAQQRQADNQKRNARIRRSIAEVLGISEERVRTLDIQKWILWEELSHDAADRRCPYSGVQISASMLLGERVEIEHILPFSMTLDDSLNNRTVALREANRIKRNRAPWEARADFEAQGWSYDGILQRAERMPLRKRYRFAPDGYERWLGEDKDFLARALNDTRYLSRVAAEYLRLVCPGSATRVIPGQMTALLRGKFGLNDVLGLDGEKNRNDHRHHAVDACVIGVTDQRMMQRFAQANAQAREDGLTRLVEDMPLPWPTYRDHVERAVHHIWVSHKPDHGFEGAMMEETSYGILRDGSIKQRRKADGSAGREISNLIRIAEPGQPQRHGVDAEGRPLPYKGYVGGSNYCIEITVNDKGKWEGQVISTFDAYRIVREGGLRQLRHPTQGQNGRALAMRLVIGDSVRLEAGEGSLQTLRVAKMSAAGQVFMSEVNQANVDARNRNGDLPYVSKMAGSFQKARARQVTISPIGELRDPGFKG

SEQ ID NO: 507 - protein, 1044 aa, Artificial Sequence
  Cas9
MKYTLGLDLGYNSIGWAILENDENGSPIKLFNAGVHIFEPSIEDIEIDGKGKTKNVKRREARLRRRQLFRKTKRLEKLLNFFIQEGFFQNQKVLINDPFERAEFLYQLDKKSRNPYILRREALDNRLSLEEIARIFYHIAQHRGFKSTKRELAEMNKDEKKKKEDGIIQSEINTLKEEIKKNSCRTLGEYFAKLFENGEKIRGRHTDRKMYEEEFQKIFNKQKEFYPNIFTDEFKKKLYKLIFHQRELKSQKDKVGFCSLERGKKRAPLALLVSQRYRYMCKVNNLNVIDTETGENRELTVDEKKKLYEKLENSEKLSFKEIKKILNLSEKRYIFNLEKSEKYIIGNKTNVKMKNIIKDWDNFDEDKKNFFINEARTVVKIETLERRGKKLGLSDEESKEFSKVVFEDGYLNFSKKAVEKLLPYLKEGKKEYEAIKLAYPENSVQNDNLKELDFLPPIKSKELKKYFEVRNPIVEKALTETRYLVNFLIKKYGKPETIKIELARELKLSNKQKERKHKENQENRKKREEVIEKLKNDLKISEPTETQIQKYLLAEECDCKCPYTGRSISMDSLFGEHPLFDIEHIIPFDRSLDNSFLNKTLCYSEENRKVKHNKTPYEAYYGTEKWEAIIERVKKFKSNVRNEKLRRFQMTKEDVENYIQNFSTQNLNDTKYASKLAKKYLGLLYGSINEDGIDKNRKRRIFASSGKVTSTLRYALGLNTILNDENIKTREDHRHHAIDAITIALTDSSMIKKISDASKREKNINSLFKDFQAPWENFRKEVEEIIAKMNISIRINKKVSGQIHDETFYKKPFKEEEKSYTHQRINLEELTIKDEDKKKQSSKLIDNIVDSKIRNIIINSLNGEKPKIRFKDPKDHPYIIQKNGKKIQIHKVTIKTKLETYNEIGPEKAKRYVKSSDSHHIEIFEDLKTKKWDGYVVSLLEAYERKKKKLPIVNKNLGEGKKFLFSLAKGEIIELDTENGKRELFVVRIISASNNQIKFTRINDSRKITDIPATGLTACPSSLKKRNCKKVVINILGEKHYSND

SEQ ID NO: 508 - protein, 1044 aa, Artificial Sequence
  Cas9
MAEKKFKYRLGLDLGTNSIGWCMLRLNKDNEPAAVIKSGVRIFHDGRNEKTKEPLAVVRRNARSIRRNLDRKISRRNHLLNTLVKYFLLPSNEIERKALAVLNPYELRSRAVNERLELFELGRLLMHLSKRRGFKSNRKVDKEDSSGKIKPAIERLKNKMQETNKKTAGEYLYSLMQNGKPVRARLGRIDGSNGYEIYLDRALIEEEYNLIMNEQKKHHKELTDDIINEIFNIIFYQRPLKKQIIGKCSLTGEDTKLKKAHVLAQDFILLQKVQDLRVFDDNQLEFRPLSNDEKDIIKRELRKKKEVSYENIRKLLKKYYENVKYGMFSHETLYKKLQGNKTNALMSDKEIIGDSWYSLSPEVQYDIIEELYSDKDNDELSKLYSEKFNLNESQINGLLNKAIYRLDSGYIRYGKTAVTNLNSIMDKDNLNLHDAREEAGYEKENKQDASEYLEYYGKVLPDSVVDPQIENPKNDEERYGKIANPTVHAALNQLRKLVNELIKLYGKPEQIVIELARDLKNSRKAKDVINKKIAENRKLNEEVDKTLQEYSEKYNTHIVKNKLNRDKVKLWRELGKDPLERKCIYTGEQINIAKLFSDEVQIEHIVPYSKTLDDSFNNKTLSMKQANYYKGNKTPYEAFKDSKDGYNYDDIIARAKLLNNDNKFKRFTKDAMDIYNRDGKDFIARQLSDTQYLSTRALIYLQSLYEKAHHSSIWTIPGQLTALIRNYLGLNTLISNDKNKNRNDHRHHAVDAFVVAVTSRSLLQKISYAASLQEDLDNRNVSSYRNKLLEKMPEPFPNYRKSLELAIDNIKTSHKADRSISGKLHEDTAYGIVENDDKYNVVTRWTVDKFKEQKHFETIRDNELKEIACSDKELFAKIVETRKIKSIRKLAKENPVIKIKDKSGRDYKAFAGGNNICVEIYEVDGVRKSEVIQLFDAAQKGFMPEWMKKYPNGKLLMRLFKGDVIGFIENRKYNYYTIKGISIADQNLKLLAINKAEGIFKKGLNILFDSNNKNSLNAKQFNISVTGIVTKKKTADVNFWKNRK

SEQ ID NO: 509 - protein, 1044 aa, Artificial Sequence
  Cas9
MLHKMRYRLALDLGSTSLGWAMVRLNANQQPCAVIKAGVRIFSNGRNPKDGSSLAVTRREARSMRRRRDRLLKRKARMMRTLIEYGFFPANETQRKALENLNPYALRAKGLDEALTPSEFARALFHINQRRGFKSNRKTDKKDSDSGALKTAIKQLHSVLDPQGNDGKPRTVGELLYKRFTDLSKLPKDRTVRARYRQDKIVKDDGKTKIDKYYDLYIDRAMIEQEFDALWKKQSELNPILFTENARADLKDVLLYQRSLKPVKPGRCTFMSEEERAPLALPSTQRFRMYQEVNNLRILREGLKEESLTLQQRDDLINALEKNNRRTFTQIKKLLGVGGSVQFNFEDPKREELKGNTTSAILGKSEHFGEAWFAFNEAKQDAIVLQLIKEENEAKLVRWLQDETGIDEKRAEVIANAGLPEGYGSLCIEALARILPELRRDVVTYDKAVQAAGFEHHSKLNRNEEIPDITFKIESIDRNSGEIKQFHLHKELPYYGEYLQRHVGFGSGKPEDSIEKRYGKIANPTVHIGLNQVRVVVNALIKRYGHPSEIIVEVARDLKQSKDRRDEENKRQAENQKRNERLRKDIADILGISEERVRRDDIEKMILWEELSFDPADRRCPYSGVQVSTVMLLSDEVEVEHILPFSQTLDDSLNNKTVALRQANRIKGNRTPWEAFGTSNISGFDYSGILTRAELMPKAKRYRFAEDGYQRWLKDDAGFLARALNDTRHLSKIAREYMSLICPNTRVIPGQMTAMLRRNFGLNDVLGLNGEKNRNDHRHHAVDACVIAVTDQGLLQRFAAASASARERQLNRLVENMPLPWESYREHVRRAIDGIWVSHRPDHSHEGAMHNDTAYGLRGNGRVSFHKMVEGKREYIEDNLKVIEITDTKAIDRHGLLPTGKPRPYKGYKGDSNYCIEIVRNEKGRWEGEIISTFDAYQLVRKYGIVQLRYPVLSVSGKPLVMRLIRNDFVRLEHEGITRTLRVCKMREDGQVALADVTEANVDARTRTKEICYVFKTGGSLQKAKARRITISPIGELRDPGFKE

SEQ ID NO: 510 - protein, 1045 aa, Artificial Sequence
  Cas9
MQKEKPLAYRLALDLGSTSLGWAVLRLSAPGEPSAVIRAGSRIFSDGRNPKDGSSLAVTRRAARAMRRRRDRLLKRKARMLAALERHGFFPQDEAARKALEKLNPYGLRARGLESALKPEEFGRALFHLNQRRGFQSNRKTDRKDSDSGALKQAIGTLRAQMHESGCRTVGEWFWKVRMERKPEGVKGQGVRARYRETPFTTDEGKKRIDKRYDLYVDRAMVAQEFDALWAAQATFAPALFNEAARAELRDILLHQRKLRPVQPGRCTLVPEEPRALLALPSTQRFRIYQEVNHLRVLHDELREEALTLAQRDQIVALLERQAKVTFTAMRKALGFSALFNLEDAKRDGLKGNATTAALGKKDLFGPLWAGFDTALQDEIVTQLMTEESEPRLIAWLQEHTGVDEARAQAIANAGLPEGYGSLGRTALARIVPELQRDVITYDKAVQAAGFAHHSDLGFSFEHDADEVERIGERTIASTGEIKPVFAFKQLPYYGRALQRHVAFAKENPRNDEERYGKIANPTVHIGLNQVRVVVNALMCRYGRPTEVVIELARDLKQSREQKLEAQQRQADNQKRNARIRRSIAEVLGISEERVRTLDIQKWILWEELSHDAADRRCPYSGVQISASMLLGERVEIEHILPFSMTLDDSLNNRTVALREANRIKRNRTPWDARTDFEAHGWSYDGILQRAERMPQRKRHRFAPDGYERWLGEDKDFLARALNDTRYLSRVAAEYLRLVCPGSATRVIPGQMTALLRGKFGLNDVLGLDGEKNRNDHRHHAVDACVIGVTDQRMMQRFAQANAQAREDGLTRLVEDMPLPWPTYRAHVERAVRHIWVSHKPDHGFEGAMMEETSYGILRDGTIKQRRKADGSAGREISRLIRITEPSQPQRHGVDAEGRPLPYKGYVGGSNYCLEITVNDKGKWEGQVISTFDAYRIVREGGLRQLRHSTQGQNGQALAMRLVIGDSVRLEVDEQERVMRIVKINGNNGQVFMAPVHEANVDARNSDKNEAFAYTSKIAGSFQKTKARQVTISPIGELRDPGFKG

SEQ ID NO: 511 - protein, 1045 aa, Artificial Sequence
  Cas9
MKPRNLNYILGLDLGIASVGWSVVEIDENEYPIRLIDVGVRTFERAEVPKTGESLALARRLARSTRRLIRRRAFRLLKAKRLLKHHQIVNAEELTQLPNQCWELRVKGLDSLLSNTEWAAVLLHLLKHRGYLSQRKNEAQNADKELGKLREGMDNNSKLLLENNYRTPADIAVKKFAVEEGHMRNQRGAYTHTFNRLDILAEMQLLFKTQRELGSTYANGELEQAFCELLLWQKQALNRSQMLSLVGKCTFEKEEKRAAKASYSAERFVAIQKLQNLRILENGEERGLFDSEFSLLLENAYNLKSGLTYKQVRKILSLSENAIFKGLPYLSDDLEKPEKTQFLAFKFYHQLADILKNNGFSDEWQKLSQEPTLLDKLGTELSLCKEENEFIAQFNGELPEAMLSTLFNHTNFDKFIHISLKALNNILPLMEQGNDYTKAWRKVYPEPTKKDEKTLPPIPADEIRNPVVLRSLSQARKVINAVIRLYGSPARIHIETARELGKSYDDRQKIKKQQDKNSDERDQAVKKFLEECPNFANKVKGKDILKIRLYINQDGKCLYSGKPLDPHRLLEIGYVEIDHALPFSRTWDDSQNNKVLVLANENQNKGNQTPFEWLGKDEHQWALFVARVNGCRFPYAKKQRILTKKLDEQGFLKRNLNDTRYVSAYLMKHIKENLHLVGKGSDKVFASNGQVTNFLRRCWGLEKKREEGDRHHALDAIVVACSTASMRQKITLFKKYQRWNLKTGKHIDQETGEIIPLHFPAPWDFFRQEVMIRIFSEMPQEDLIMQLPDRPQANHEFVQPLFVSRAPSRKMSGQGHEAKLRSARMLEATGKSIKKEFLTDLTIKNLEHMVNKEREPELYQALVEHFKKYGDKPKEKFFKKGGVEVKSIRISKTQNKSVNLGNKTIADNGDIVRTDLFLKNKKYYFVNIYAWQVSKGILPKETTTGNILDNSYEFQFSLFKNDLLEIPHPKNENDSILAYFIRPDDERRWILKFHDNAKIPDIYGKKDETSIRLSIQGQKFIKKYQVDELGKNIRPCRPTKRQGVR

SEQ ID NO: 512 - protein, 1046 aa, Artificial Sequence
  Cas9
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFVNVRNKTGNYEHCVAQDMLKDELELIFRKQKELGLHLSDGFEKQLLDKIFEQRPLKSFADKVGKCQFIAGAKRAPKDSISAIEFVALSRIINTLANLSKKSGEMYDKAMVLTILDSVLEKGEMSYYALREAINLDEKIRFADSRLDYSKEIKETEKVKFVECKNLKSFKKVLGNCYKTLERKHIDSIAERIAVIKDVEKLHKELESYCATEQLSLTSEQIQALSHLNFSSHISLSLKALEQILPFMRGEREARSSDADYCIGIDESGESQCLRYDESVEKAGLKALSKDTLKGQILPPLNEFEPYLANPVVARALAEYRKVLNALLKQYGSPHKIHIEYAREAKLNTTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLSLVESENTTLGKGQKGSKKHIAIVNGALTSTMRYYLGFASKDRDNHLHHALDAVIIGFMNDSVIKAFSDFKKTQETSKAAYYAHTLSKQEYKKQRAFIQLPSGENFRANVLEKAESVFVSKPPRKRVRGALHEESFYSQNDTKLLKSYGGAEGIEKALQLGKIRQIGTKIVSNGAMVRVDIFKHRKSGKFYGVPVYTMDFALGILPNKAVVQGKDKNDVIKDWLEMDSSYEFIFSLYKDDLLLVQKKEMAEPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 513 - protein, 1047 aa, Artificial Sequence
  Cas9
MKLLRYILGLDLGIASVGWAIVEIDENDFPIRLIDIGVRTFDKAEVSKTGESLALARRLARSTRRLIRRRAFRLLKGKRLLKQHNVINKEALTTLPTDCWALRVKGLDERLSPTEWSAVLLHLLKHRGYLSQRKNEAKSADKEMGALLSGVASNHQLLVENQFRTPAEIAVKKFALEEGHIRNQLGAYTHTFNRLDLLAEMKLLFQTQRELGNPHTSGQLEQEFCELLMWQKPALSGDAILKMLGKCTFETNEYKAAKHSYTAERFVWLTKLNNLRILEHGSERVLNTDERSLLLNQPYEKAKLTYTQVRKLLGLSEEARFNGVRYGKEKAEDATLIELKAYHAIRKAVEKADKSAWETLKNQTALLDEIGTTFSIYKTDDDITEQLNGKLSDTVLNALLENLNFDKFIQLSLKSLYNIVPLMEQGLRYDEACQQIYGDHFGKKSGEINRLLPPIPADEIRNPVVLRSLTQARKVINAVIRLYGSPARIHIETARELGKSYKDRKEIEKRQEQNRAEREKATAQFKTLFPTFIGEPKGKDILMMRLYEQQNGQCLYSGKPLNLNRLLEKGYVEIDHSLPFSRTWDDSQNNKVLVLAGENQNKGNQTPFEWLGKDEHQWALFVARVNGCRFPYAKKQRILTQKLDEQGFIERNLNDTRYIARFLVNFVRENLHLTGKGKNRVFASNGQITAFLRGRWGLSKVREESDRHHALDAVVVACSTVAMQQKITRFVKYQEGNLQTAERIDRETGEIIPLHFPDPWHFFRQEVMIRIFSENPQEDLIIQLPDRPEANHEFVQPLFVSRMPTRKMSGQGHMETIKSAKRLDEGISVSKVPLTQLKLKDLDNMVNREREKALYEALKARLNAFNDDPTKAFAEPFYKKGGQQVKAVRVEQVQKSGVVVRNGNGVADNASMVRVDVFIKGGKYFLVPIYTWQVAKGILPDRAVVAAKDESEWELMDKTAQFLFSMFPNDLIQVKTKKETFFGYYNGLDRATGAINLKEPDSNINKGKSGLHRSIGVKTALSVEKYQVDELGKNIRPCRPSKRQAVR

SEQ ID NO: 514 - protein, 1048 aa, Artificial Sequence
  Cas9
MKRLGLDIGTNSIGWCLIEDDGDGKGRIIDIGARIFSDGRDPKSGASLAVDRRAARAMRRRRDRYLGRRTAFLKALKRFGLMPADESAAKLLADRDPYELRARALDERLEPHEIGRALFHLNQRRGFKSNRKAERKTKDAEDGKIANGAKALDQAMAESGAETLGQFLSSRDTKRVRMGSDAQGYDFYPQRRHVEYEFDTIWSRQQQHHPALLTEEARKKLHDILFFQRPLKEQEVGVCTFVHNECRLPKAHPLFQERRLYEEVNQLEITTPGAPNRKLTMDERDALILELRSRKERSFDSLAKRLKLAPGQSFNKASESRTRLRGDEVYAVMAHKKRFGDRWPHLDRDRQWAIIKRIIEEEDPDKLHAFLTGEWGLTDEQALATARAPLPELYGRLGPTATARILEELKKDVITYDEAVRRAGWHHSDDRTGEILPQLPYYGELLTRDIPPGTQDPNDPPEQRWGKITNPTVHIGLRQLEKLVNAIIKVHGRPDQIVVELARELKLNEKDKEEHNRRIRRDTAAAQLRSAKLQSEGIPDTGANRMLLRIWEELNPGEVLDRRCPYCGEPVGMRMLFAGEADIDHIIPYSRSLDDSAGNKVVAHRSCNRAKGNRTPYEKWVHDPDRWDVISTQVARLHKSKQWRFGPDAMARVEKDGGFIARQLTDTQYLSRLAGRYLSSLYPTKDDGSVYVIPGRMTAMLRRRWGLNSLLPDHNFVDNEHSNAPKNRLDHRHHAIDAAVVAVTTRALMQEIARTAGRAEDKDLDRLFEDLPQPWEGFREELGEKLVRVTVSHKPDHGRKGLPPKNRDVTAGRLHNDTAYGLTGDVAADGKTPIVVHRVPLMSLKPADISDPDRIPDPALRSALHRATDGLSGKAYDAALAGFAKTHPQFAGIRRVRVREPLTVIPIADRDGRPFKAYKGDANSRVDIWRMPDGKWLSDVVTMYEAHRRDHSDRRPHPAAKKLMSLRQNDMIAVERDGAPRQIMVVKQIWPTQINLVEHKETGNLKDRHSNETDPFRFFAPTAGGLKKMKARQVRIDPLGRIFDPGPR

SEQ ID NO: 515 - protein, 1048 aa, Artificial Sequence
  Cas9
MANIAENLVFGIDLGIGSCGWAVLNQKAKDENIVALGSWCFDVPETDKERIPTNQIRRANRLLRRVIRRRRNRMAEIRRLFASKGMLDTADPDALAKISADPWEMRAKGLDYQLTPQEFAVALGHIAKRRGFKSAAKRVSTNAPSEDSKMLAALEKTKEQSAQYRTIGEMFARDPAYADRRRNRDGCFDRTMSREDLFKETQILFESQRRLGNFSATSETEQAFIDIAFRQKPMQDSERLVETCLFEPDEKRASRFAPSFERFRLLCRLVNLRVTDGLEDRPLTPEELRLACEDAGKTRKLSVKKVRSLIGLRDDQRFTTIPPDQEQHDIAARTGDALTGTATFRAILGESFWRQLLPHPEQLDRAAWIISFHELTDTIISKLATIGLPSEVMELIRKALEDGKFSKFKGAASLSDKAARKLIPFLQEGLTYDKACQKAGYNHAASKFTHYDSIDTKAKFNSLMDDVRDSITNPVARKAISEGMKQVWAMRNQWGLPGAICIELARDVGNSAEKRREIESGIKKNTAQRERERQEAKEHLNQSDISSETLLRYRLWKEQGGRCCYTDQPITPSQLIASDNSVQVDHILPWSRFGDDSYLNKALCTAKANQEKKNRTPWEWIHNQKGVEAWNHFTAAVESRKETRGLKKRNFLLKSSKETEERFRSRNLNDTRYAARVMAEAVRLLYPSGNRAEKGGVKRVFTRPGALTAALRHAWGVESLKKINGKRLNDDRHHALDAAVVAAVSEKEIQKLTKSFQICEQKGLARPMRDVPMPWEGFRHQLETAYADIRVARPERRRARGKGHDATIRQLREEKDGPVVYERRAISDLKLTDLERIKDPERNSAIISSLRTWIEKGKPADYPPQSPKGDEIRKIRVMSRNKPAVSVRGGTADRGEMTRVDVFTKMGKKGKPEWFLVPIYRHQVIDRIQWPQPPNQAAANGKSEKNWPTMGLEHEFRFSLYPRSYVQIVKRDGEIIEGYFAGLDRTVAAFSLLSSSDPTSIQRGIGAKTLESIRKYNVNRFGDISMVEQETRTWHGDVCISPDQPDSA

SEQ ID NO: 516 - protein, 1048 aa, Artificial Sequence
  Cas9
MVEKILGIDLGISSLGWAVVEYDKDNDENNKIIDCGVRLFTAAETPKEKESPNKARRDARGLRRVIKRRRVRMNTIKNLLITYKLIDKTLLDEEMGMFHSQSNRVDVWKLRHDALYHLLSGDELARVLIHIAKHRGYKFLGDDESDEESGKVKKAGAELKKKFLEAGCQSVGEWLWKERGLQGKKRNKSGDYEISIPRDFLVEEIQRIFETQQKFGSTFATSELQKAYTDIAFYVKPMQSIEDMVGYCTFYPKIKSKNQDGEKRAPKASPSAEQFVILSKIFSTIVIDENKQEKKLIELKSIEQLIQIARSKETLKYKQLRKELNLAKDISFKSISDEEKTWINLVGNAKFKKILGLNYETFLKNTEISDEIAKILTYDKTFEQKETKLKNLLVNIDWIDNNHIAELAKLSFSQFNQLSLKAIKIISKIMIEGYARYDEAVQYAFENNLLPKPSHEKSILLPPLKETNIAILNPTVIRAFAQFRQVANALVSKYGSFDKVHFELAREVNTKEDRKRWEKDRDKNEKMHRQITEKLVEEGVKPSYKNILKSKLRSEQKDTCPYCQKNLHYPMIFEDGYAEIDHILPLSQSQDDSYVNKVLVHSACNQNKKNRTPFEWFQDEKKDWDTFKSYILMESTLGEKKRNYLIKENFSDPQSRKEFISRNLNDTRYMSKAIKTYCENHWKLSHDDDKLRIQVRSGKLTSTLRHQWGLDNKNRETHTHHAMDAIMIAFSTQGMVKKLSDYFAKKEAKVEKDKPVLITPIKQFKEAVEQATTLERQESIQTKAGDTITLNRLLISRPPRASVTGAAHEQTAKPYPRIKPIKNKYKRRRIPIDEDKFELFRNDKVASGNDKNFYNSSTIPRVDIYKKDDKYHVVPIYLSDMTKAEVPNKSLGTNPEGMDEKYFCFSVFKNDLIELETKATPKKPSKKLLGYFKQLNGANFILNSIHNGIIDGFVCSPITLFKQQKDMCKKCLPEDRAIGNCSQETLEFWEAENIKVPKKDFECDQGIKFAIAVRKYTIDPLGYYHEVKGEKLLGTIPQGAKKHPKRQK

SEQ ID NO: 517 - protein, 1049 aa, Artificial Sequence
  Cas9
MINERLTFGIDLGIGSCGWAVLRHADAAGEPGVIEGLGSWCFDVPETSKERIPTNQVRRSNRLLRRVIRRRRNRMAEIRRLFHAQGLLPSADEDALKRPRLDPWELRARGLDQCLSAEEFAVALGHIARHRGFRSSAKRKAANTSGEDSKMLSALLVTRERTARYRTVGEMFARDPEYSARRRNRDGIFDRTVARDDLIHEVGKLFEAQRARGSAFASPDLEADFNAIAFRQAEMQDSERLVGNCPFERDEKRAARWAPSFERFRLLTRLINLRIATAEGERRFTPEDLARVSAELGATAKLPVSRVRALIGLLPDERFTTIRVEDEDRDIVARTGEAAPGTWRLRKTLGEALWAEMQARPDQLDAIAHVLSFFEATAKIRSELDRLGLPAAVIEALDRGLEDGAFAKFKGAGHISAKACRNLLPHLQQGHRYDQACRLAGYDHAASTLSHTAQVVSKAGFNALVTELGESIANPIARKALTEGLKQIRAMCARWGLPGAIHIELAREVGNSIEKRRELESQRETTTKRRQTERDEIRGLLALEDVDDDTLLRYRLWKEQGGKCLYTGKDIHVRQLIATDNSVQVDHILPWSRFGDDSFNNKTLCLASANQRKRGQTPWEWFSLTGTPEAWEVFASRVETSKDLRGFKKRNLLLKNADEVAQRFRSRNLNDTRYAARLLAEAAKLFYPAGDRQEKDGRRRVLTRPGPLTAALRHAWGLESLKKADGKRVSDDRHHALDALAVAAISEREVQRLTRSFQEWEQQGLARPLRHVAPPWPGFRGDVLAAYAQAFVARPERRRARGKGHDASIRQVVGEGPEAQVFERRGLADLKEADLDRVKDPERNQAIIEAVRAWILAGRPADAPPRSPRGDVIVKLRTAPAKKIKPAVPVRGGTADRGDMVRIDVFTRPNRKGRDEWYLVPIYPHQVMNRKAWPHPPMRSVVAYKDEAGWTEIGAEHSFRFSLYPRSYVQLVKSNGDVIEGYLVSMDRSTGAFRVFVHNNPAEMAKGIGAKTLLNLRKFNVDRFGVRTEVKSEVRTWHGEVCTSPVPPD

SEQ ID NO: 518 - protein, 1049 aa, Artificial Sequence
  Cas9
MQLSKLNYILGLDLGIASVGWSVIEIDETEMPIRLIDVGVRTFERAEVPKTGESLALARRLARSTRRLIRRRAFRLLKAKRLLKNHQIVSADELSTLPNHCWELRVKGLDERLTCQEWAAVLLHLLKHRGYLSQRKSEAQNADKEMGALLSGVANNHKLLSENHYRTPAEIAVKKFALEEGHMRNQRGAYTHTFNRLDLLAEMRLLFQTQRELGSPYASGELEQEFCKLLMWQKPALSGDAILKMLGKCTLEPTEYKAAKNTYTAERFVWLTKLNNLRILENGSERALNADERALLLNQPYEKAKFTYEQARKLLQLNEAARFNSVRYGKENAEKSTLMEMKAYHAIRKAVETADSSAWATLKTQPLLLDEIGTAFSIYKTDEDIKTQLQGKLADNVIDVLLENLNFDKFIQLSLKALYKILPLMEQGLRYDEACSQIYGDHFGKKEQKNDRLLPQIPADEIRNPVVLRTLSQARKVINAVIRLYGSPARIHIETARELGKSYKDRKEIEKRQEQNRAEREKAVDKFKELFPNFIGEPKAKDILTMRLYEQQNGQCLYSGKSLDLHRLLEKGYVEIDHALPFSRTWDDSFNNKVLVLAGENQNKSNQTPFEWLGKDEQKWALFTARVNSCRFPYSKKQRILTKKLDDEGFIQRNLNDTRYIARFLVNFVNDNLHLTGKGKRRVFASNGQITAFLRGRWGLTKVREESDRHHALDAVVVACSTVSIQQKITRFVKYQEGNLQTAERIDRETGEIIPLHFPDPWAFFREEVMIRIFSEMPQEDLVIKLPDRPQANHEFVQPLFVSRMPTRKMSGQGHMETIKSAKRLDEGISVSKVPLTQLKLKDLENMVNRDREIALYEALKARLTEFKDDPAKAFAEPFYKKGGVQVKSVRVEQVQKSGVVVRNGNGVADNASMVRVDVFIKGGKYFLVPIYTWQVAKGILPDRAVIAYTPENEWELMDDSAQFQFSIYPNDLIKLTTKKAIFFGYYSGFNRLTGAINIKEHDLQISKGDKGVHLGLGVKLALSLEKYQVDELGKNIRPCRPTQRQNVR

SEQ ID NO: 519 - protein, 1050 aa, Artificial Sequence
  Cas9
MSSYRFSFDLGTNSIGWAVFELDPKTRPVALADCGVRIFPDGRNPKDKQSLAVARREARAVRRRRDRYLKRRSELMERLVAKGLMPESRDDQKALEGLDPYALRAAGLDDALPPHHFGRALFHLNQRRGFKSNRKTDRGENSETGITKIGMKKLHEALLSEGCRTLGELQHRHHEANQTPAMDTNPKSVRSKLRGEGAKAVYDFYPSRDAVEDEFNKLWDSQKRFHPDLLTDSARDAIRDAIFYQRKLKTPDAGRCSFNPAEERVARAMPIAQHFRILQFVGDLRLIDNDLVRHPLNNDQKKALYRDLLAKGKLTFKAMRKTIGIGSEYAFSHESEKQSEFRGDETAARLAGPKYFGPKWRELSFNDQSEIVDRLLHEENEETLIQYLQDRFGFDHDRCEVIADAPLPDGHTRLGKTALETLVEIMRDDHLPYDQACTKAGYEHALPPDGVILDDLPYYGIALERHVAFGDGKSENPEKRYGKIANPTVHIALNQLRKVINALIARYGHPDQVVMEIARDLKQSKAKRDDISKEQKKNQDRNDQRRKKLQEAHIAVNAENMLRMRLWEELDEDNAAARACPFTGETISMARLFSPEVEIEHILPFSRSLDNSPANKTLCMVWANRAKGNRTPWEAFGRDREPGFDWPEIAARAARLPKNKSWRFGPDAMERLEREGDFLDRQLTDTQYLSRIAREYVTKICDPNQVWVTPGRLTAWLRRNWGLNGILPTGNATKNRDDHRHHAIDAIVVGLTDRGILNRVSRSAALAEAEDLDRSIAEMPDPFDGFRDNIRHILEQIIVSHKPDAGFVPGHPKGNTTPGALHNDTAYGIIKTDAKGMSEVVTRKDVLSFKGTKEIESIRDAATRQSLLDAVAGVPSGLAFKEALRDWSVRTGTKRVRVTFNMSVIPIQDRDGKAYKGYKGDGNLCAEIYERPDGKWGDEIISRFDAVQPGFTPQWQRDHPAAHRVMRLFRDDMIMAEIDGVMTVCRIVKMSPGKVVFTPHHEANTDSRNRDKDDPFSFHTCSGESLRKRKAQKLFVDPLGKIRGYRAKEG

SEQ ID NO: 520 - protein, 1050 aa, Artificial Sequence
  Cas9
MGENMIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALTISAHNDPKSIHSGIGTKTLLAISKYQVDRFGRKSPVRKEVRTWHGEACISPTPPG

SEQ ID NO: 521 - protein, 1050 aa, Artificial Sequence
  Cas9
MKILGFDIGIASIGWAFVENGELKDCGVRIFTKAENPKTGDSLAMPRREARSVRRRLARRKGRLETLKRLLAKEWDLCYEDYIAADGELPKAFMGKNLNNPYVLRYEALQRLLSKEELVRVVLHIAKHRGYGNKNAKITKSEESKREQGKILSALATNASAIARYRTVGEYFYKEFCEVIKNPQGLSTNEHYTQSKVRVLKPIRNKGGEYTNCILQEDLQRELRCIFEYQKGFGFPITQEFQDKILKIAFYQRPLKDFSHLVGKCTFYPDEFRALKCSLSAVEFITLSKTINVLTYISKESGEVYSKGQYEQMLDSVFKAVCEKGSLSFAQLRKILHIDERIRFKEVDYMARKSKNTSGDSTHKQKTSNPETKKFIEHKNLKKFCEILSEIAEDRALADSIARDMTLIKDEEKLAQKLHGYGKFSQEQITQLSALNFSHHINLSLKALSEILPFMREGMRYDEACKLAGLKARHNDKKSKFLPPFCESIYADELTNPVVHRAIAEYRKILNALIAKYGSVHKIHIELTRDVGKNFQEREKYKKEIESNYKARVQAMQECEKLGLTLSEGNILKLRLFREQNEICVYSGRKITLANLKEQGALEIDHILPYSRSSDDSYMNKVLVFTNENQNKGNKTPYEAFGGDSQKWGEIESLALRSGYPKKKAKRILDKGFGDREAGFKSRNIVDSGYIARLIANYTKEYLKFLPLDSHENTALIAGEKDSKIHVEAVKGMLTATMRHFWGLGSKNRYEHTHHAVDAIIIAYINAAMIQRFSQFRQNQESLKARFYAKELAKEEFKTQRAFFEPFRGFREQVLAKVGQIFVSRPPRKRARGALHEETFYSIDDKKLSETYGGKEGVQRALSLGKIRQIGTKIVANGPMVRVDIFKHKQSRRFYAVPIYTMDFALGILPNKAVVSGKDTKSKVIKDWLEMDSCYEFCFSLFKDDLIEVQKSDMEKPELAYFVSLDASDGRIKVRHHCNDITKINENQKKLFSEAIEKEVVGRGSIQNLKVFKKYKVSPLGEIKEAKYEPRQPIALKTSPKKHRKQNNAQ

SEQ ID NO: 522 - protein, 1051 aa, Artificial Sequence
  Cas9
MNNYILGLDIGITSVGYGIVDSDTREIKDAGVRLFPEANVDNNEGRRSKRGARRLKRRRIHRLDRVKHLLAEYDLLDLTNIPKSTNPYQTRVKGLNEKLSKDELVIALLHIAKRRGIHNVNVMMDDNDSGNELSTKDQLKKNAKALSDKYVCELQLERFEQDYKVRGEKNRFKTEDFVREARKLLETQSKFFEIDQTFIMRYIELIETRREYFEGPGKGSPFGWEGNIKKWFEQMMGHCTYFPEELRSVKYSYSAELFNALNDLNNLVITRDEDAKLNYGEKFQIIENVFKQKKTPNLKQIAIEIGVHETEIKGYRVNKSGKPEFTQFKLYHDLKNIFKDPKYLNDIQLMDNIAEIITIYQDAESIIKELNQLPELLSEREKEKISALSGYSGTHRLSLKCINLLLDDLWESSLNQMELFTKLNLKPKKIDLSQQHKIPSKLVDDFILSPVVKRAFIQSIQVVNAIIDKYGLPEDIIIELARENNSDDRRKFLNQLQKQNEETRKQVEKVLREYGNDNAKRIVQKIKLHNMQEGKCLYSLKDIPLEDLLRNPHHYEVDHIIPRSVAFDNSMHNKVLVRADENSKKGNRTPYQYLNSSESSLSYNEFKQHILNLSKTKDRITKKKREYLLEERDINKFDVQKEFINRNLVDTRYATRELTSLLKAYFSANNLDVKVKTINGSFTNYLRKVWKFDKDRNKGYKHHAEDALIIANADFLFKHNKKLRNINKVLDAPSKEVDKKRVTVQSEDEYNQIFEDTQKAQAIKKFEIRKFSHRVDKKPNRQLINDTLYSTRNIDGIEYVVESIKDIYSVNNDKVKTKFKKDPHRLLMYRNDPQTFEKFEKVFKQYESEKNPFAKYYEETGEKIRKFSKTGQGPYINKIKYLRERLGRHCDVTNKYINSRNKIVQLKIYSYRFDIYQYGNNYKMITISYIDLEQKSNYYYISREKYEQKKKDKQIDDSYKFIGSFYKNDIINYNGEMYRVIGVNDSEKNKIQLDMIDISIKDYMELNNIKKTGVIYKTIGKSTTHIEKYTTDILGNLYKAAPPKKPQLIFK

SEQ ID NO: 523 - protein, 1052 aa, Artificial Sequence
  Cas9
MENKNLHYILGLDLGIASVGWAVVEIDEKENPLRLIDVGVRTFERAETQKGESLALSRRSARSARRLTQRRVARLKKAKRLLKSENILLSTDERLPHQVWQLRVEGLDRKLERQEWAAVLLHLIKHRGYLSQRKNESKSENKELGALLSGVASNHELLQQATYRTPAELAVKKFEVEEGHIRNQQGAYTHTFSRLDLLAEMELLFSRQQHFGNPFASEKLLENLTALLMWQKPALSGEDILKMLGKCTFEDEYKAAKNTYTAERFVWITKLNNLRIQENGLERALSDNERLMLIEQPYEKAKLTYAQVRSILNLSDDAIFKGVRYSGEDKKAIETKTTLMEMKAYHQIRKVLEGNNLKAEWVALKANPTLLDEIGTAFSLYKTDEDISAYLAGKLSQPVLNALLENLSFDKFIQLSLKALYKLLPLMQQGLRYDEACREIYGDHYGKKTEETHHFLPQIPADEIRNPVVLRTLTQARKVINGVVRLYGSPARIHIETGREVGKSYKDRHELKKRQEENRKQREKTISEIKTLFPNFSGEPKGKDILKMRLYYQQNAKCLYSGKPLELHRLFEQKYVEVDHALPLSRTWDDSFNNKVLVLANENQNKGNLTPFEWLDGKNNSERWRTFKALVETSAFPYAKKQRILSQKLDEKGFIERNLNDTRYVARFLCNFIADNMHLTGEGKRKVFASNGQITALLRRRWGLAKSREDNDRHHALDAVLVACSTVAMQQKITRFVRFKAGDVFTGERIDRETGEIIPLHFPTPWQFFKQEVEIRIFSDNPKLELENRLPDRPQANHEFVQPLFVSRMPTRKMTGQGHMETVKSAKRLNEGISMIKMPLTKLKLKDLELMVNREREKDLYDALKTRLEAFNDDPAKAFAEPFMKKGGAIVKSVRVEQVQKSGVLVRQGNGVADNASMVRVDVFTKDGKYFLVPIYTWQVAKGILPNKAVIQGKDEEDWEDIDDATFQFSLHPNDLISVKTKKDEFLGYFNGLNRHTGGINIRTHDLEKSKGKQGIFEGIGVKIALSFEKYQIDELGKNIRLCKPSKRQPVR

SEQ ID NO: 524 - protein, 1052 aa, Artificial Sequence
  Cas9
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMTGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 525 - protein, 1052 aa, Artificial Sequence
  Cas9
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 526 - protein, 1053 aa, Artificial Sequence; identical to SEQ ID NO: 430
  Cas9

SEQ ID NO: 527 - protein, 1053 aa, Artificial Sequence
  Cas9
MKRNYILGLDIGITSVGYGIIDYETRNVIDAGVRLFKEANVENNEGRRSKRGTRRLKRRRRHRLQRVKKLLFDHNFLTDNSELSGISPYEARVKGLNQKISEEEFSVALLHLAKRRGVHNVNEVEEDTGNELSTKEQISRNSKALEEKYVAELQLERLKVDGEVRGAVNRFKTSDYVKEAQQILKVQKAYHQFDQSFIDTYIDLLETRRTYYEGPGEGSPFGWKDIKEWYEMLMGQCTYFPEELRSVKYAYNADLYNALNDLNNLVIARDENEKLEYYEKFQIIENVFKQKKKPTLKQIAKEILVNEEDIKGYRVTSTGKPEFTNFKVYHDIKSITSRKEILENAELLNQIAKILTIYQSSEDIQGELARLYSELTQEEIEQISKLAGYTGTHRLSLKAINLIIDELWHTSDNQMEIFNRLKLVPKKVDLSQQKEIPTTLVDDFILSPVVKRSFIQSIKVINAIIKKYGFPNDIIIELAREKNSKDAQKFINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYFSSSDSKISYEIFKKHILNLAKGKGRISKKKKEYLLEERDINRFSVQKYFINRNLVDTRYATRELMNLLRSYFRVNDLDIKVKSINGGFTSFLRKKWKFKKERNKGYKHHAEDALIIANADFIFKEWKKLDKTNKVMEDQIVEEQQAESMPEIETEQEYKEIFITPHQIQDIKDFKDYKYSHRVDKKPNRELVNDTLYSTRKDDKGNTLIVNNLKGLYDKDNDKLKKLINKSPEKLLMYHHDPQTYQKLKVIMEQYSNEKNPLYKYHEETGNYLTKYSKKDNGPVIKKIKYYGNKLNVYLDITRDYLKSRNKIVKLSLKPYRFDVYLDNGVYKFVTVKNLDIIKKEDYYEVDSDSYEEAKIVKKVSEQAQFVASFYNNDLIKVDGELFRVIGVNNDLLNRIEVNMVDITYKEYLENINDKKSSRIIKTISSKTQSIKKYSTDILGNLYEAKSKQRPQMTMKG

SEQ ID NO: 528 - protein, 1053 aa, Artificial Sequence
  Cas9
MKRNYILGLDIGITSVGYGIIDYETRDVIDAGVRLFKEANVENNEGRRSKRGAGRLKRRRRHRLQRVKKLLFDYNLLTDHSELSGINPYEARVKGLSQKLSEEEFSAALLHLAKRRGVHNVNEVEEDTGNELSTKEQISRNSKALEEKYVAELQLERLKTDGEVRGSINRFKTSDYVKEAKQLLKVQKEYHQLDQSFIDTYIDLLETRRTYYEGPGEGSPFGWKDIKEWYEMLMGHCTYFPEELRSVKYAYNADLYNALNDLNNLVIARDENEKLEYYEKFQIIENVFKQKKKPTLKQIEKEILVNEEDIKGYRVTSTGKPEFSNLKVYHDIKDITARKEIIENAELLDQIAEILTIYQSSEDIQEELVKLNSELTQEEIEQISNLKGYTGTHNLSLKAINLILDELWHTNDNQMAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRELMNLLRSYFRVNNLDVKVKSINGGFTSFLRRKWKFKKERNKGYKHHAEDALIIANADFIFKEWKKLDKAKKVMENQTVEEKQAESMSEIETEQEYKEIFITPHQIQHIKDFKDYKYSHRVDKKPNRELINDTLYSTRKDDKGNTLIVNNLNGLYHKDNDKLKKLMNKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLNVIKKENYYEVNSKCYEKAKKLKKISDQAEFIASFYNNDLIKIDGELYRVIGVNTDLINRIEVNMVDITYREYLENMNDKRSPRIFKTIASKTQSIKKYSTDILGTLYEVNSKKHPQMIMKG

SEQ ID NO: 529 - protein, 1053 aa, Artificial Sequence
  Cas9
MSGMVFGIDLGIASCGWAVLRQPQRDGDPGEIVDLGSWMFDVPETDKERTPTNQVRRGNRLLRRVIRRRAQRMVEIRRLFHDHGLLAGHAPEALKRAGLDPWDLRARSLDKVLEPAALAVALGHIAKRRGFKSAARRKEANTAGDDQKMLKALEATHERLGRYRTIGEMFARDPDFESRKRNRDGMFDRTQGRDDLLHEVGEIFKAQRRLGSALATAELEQAFTAIAFRQLPIQDSERLVGLCQFEPKEKRAARFAPSFERFRLLQRLTNLRVVTVEGERPLTADEIAAAAADLGRTAKLSVKEVRKRIGLAADHRFAAFKADEEDRDIIARTGEALHGTYRLRKALGEGLWAEMLPGQLDAIAHALSFFETQDVILKELDKLDLPAGVRDAIATGLDAGAFARFKGTGHISARAARALLPHLEAGLRYDQACTKAGYDHAASRWAKREQVADKAAFNRLVTDMGAEIANPIARKSLTEALKQLWAMRNRWGLPDAIHIELARDVGNSLEKRREIERAIEKNTAARERERGEARDLLGIDDVSGDTLLRYRLWKEQAGRCPYTDAPIPPGAIIATDNSFQVDHILPWSRFGDDSFANKVLCATAANQRKKGQTPCEWITAAQGEEGWATFVARIEGNAAFRGPKKRNYVLKNAKEAEERFRARNLNDTRYAARLLAEAVKLFYPEGERQDKGGVRRVFTRPGGLTAALRHAWGVEALKKRDGKRVDDARHHALDALVVAAIGEGEVQRLTRSYQEWEQQGLARPLRRVDPPWGDFHSFRREVKDAYDGIFVARPERRRARGEGHAATIRQVRERDGAAVVFERKAIADLSEKRLADIKDPERNQAIVEAIRQWIVDGRPADRLPRSPAGDEIRKVRLRTKGKPAVQVRGGAADRGEIVRVDVFTKPNKKGKNEFYLVPIYPHQVMNKAEWPTPPMRAVVAYKDESEWTLLDENFGFLFSLFPRSYVEVTKPGGEVLSGYFQGMDRSTGAISLFNHRDSRSLTDDSGNSTRGIGAKTLLTMKKYSVDRFGKRAEVKSEVRTWHGVACTYPTPPG

SEQ ID NO: 530 - protein, 1054 aa, Artificial Sequence
  Cas9
MKLTPLNYILGLDLGIASVGWAVVEIDEQENPLGLIDVGVRTFDRAEVAKTGESLALARRLARSSRRLVKRRADRIKKVKRLLKSENILLSADEQLPNDVWQLRVKGLDQKLERQEWAAVLLHLLKHRGYLSQRKNESKSENKELGALRSGVAANHQILQSAEYRTPAEIAVKKFHVEEGHIRNQRGAYTHTFSRLDLLAEIELLFTRQTELGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKHRESAVQKFKEYFPNFVGEPKGKDILKMRLYELQQAKCLYSGKSLELHRLLEKGYVEVDHALPFSRTWDDSFNNKVLVLANENQNKGNLTPYEWLDGKNNSEPWQNFVARVQTSGFSHTKKQRILSHKLDEKGFIERNLNDTRYVVRFLCNFIADNMLLTGKGKRKVFASNGQITALLRGRWGLQKVRDDNDRHHALDAVVVACSTVAMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLNDLERMVNREREMALYESLKVRLEQFDNDPAKAFAEPFYKKGGALVKAVRVEQTQKSGVLVRDGNGVADNASMVRVDVFTKAGKYFLVPIYTWQVAKGILPNKAVTANVDEIDWLEMDESYQFIFTMYPNDLVKVKLKKEEFFGYYGGLDRATGAIVIKEHDLEKSKGRQGIYRIGVKLALSFEKYQVDELGKNIRPCRPTKRQHVR

SEQ ID NO: 531 - protein, 1054 aa, Artificial Sequence
  Cas9
MRILGVDLGVASVGWALVNDKNNKIIDSGVRIFTQSTNREGKTLAAVRRSFRGGRRVLSRRKQRLNQLKKLFIAHKLLSKSEFKHLFNSKNRLDIWQLRAKGLEQQLNNKEWARVLYHIAKRRAYQSNRKSEESGNTDKKKVLSGISKNEKKMNELGYKTIGEMLYTENRYPDNRIRRNKKDQYKHSISRDLLRKEIDVLFESQRDFGNQFATDGLKEHYKDIAFTQRPIKFKADLVGKCTFETQEYRGAKNCFSVEKSTLLSKINNTDLIDKSTGEIKRLFEISEFDKLLDIFYSIKEVKYTTLRKQLKITDAFKFKQLDYHQNFEYKTNIKAKIEDFYKLEDWLTPEQKVLLEKQVLDDKKEKFKCYKYSSIRSILSLSESQKFNGVKYDTKVENTVFGKLNGYHSIKKELNKEVFDLLFIDKDKFNKIAEILSYQKDDKSATQDLKKQVFNDFNMDKTIVNEAINSLLNISFSGFNSLSLKAINKLLPYLCQGLKYHDAVAHSEYKHHSQFKAANPQQYLRPLNKEENYQITSPTVKRVFSQFRKVLNAVIRKHGSFDAMHIEMARELKNSKKIKFEIQTGQKEYAQEKEAIRVKFLEIFKYEGSGRDLLKLRLYEQQHGKCIYSKKEIEINKLLEDGYVEIDHILPWSRTFDNSLNNKALCLSAENQNKANQTPFEYLTNSDKNSKDSKEWQEYKNYVSSFAGIKQAKKHKLLNTTLPPRRGNDFSDDIKNPESGFLARNLNDTAYASRFIKNFVQNHLQFSQNDTIKQKVKVRSGALTNQLRYNWGIEEKNRDNNLHHAEDAIILAFATQGEVQRMSTISAKREDFKYQTAKERKIKFTPPFSDFKSVLDESVGDIFVSFAPRRKISGAAHKATIKPKDTGGKYKFPVNNGMAENGVIQRVDVFKNAKNKYQFIVFYPADFYKDDFPELDLKGNEIDKNVQFLFSLFKDDLIEFKTKKTKTKDSKHLLAYFKYIRSDGKIAFQQNYKAEIERKESDNKKGYKDILLATGSGLASLKKYQVSVLGDIAEVKNEKRLPLIKQMYKSKPKKK

SEQ ID NO: 532 - protein, 1054 aa, Artificial Sequence
  Cas9
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 533 - protein, 1054 aa, Artificial Sequence
  Cas9
MKLTPLNYILGLDLGIASVGWAVVEIDEQENPLGLIDVGVRTFDRAEVPKTGESLALARRLARSARRLVKRRADRIKKAKRLLKAENILLSADEHLPNDVWQLRVKGLDQKLERQEWAAVLLHLLKHRGYLSQRKNESKSENKELGALLSGVETNHQILQSAEYRTPAEIAVKKFHVEDGHIRNQRGAYTHTFSRLDLLAEMELLFQRQTDLGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKQRESAVKKFKEYFPNFVGEPKGKDILKMRLYELQQAKCLYSGKSLELHRLLEKGYVEVDHALPFSRTWDDSFNNKVLVLANENQNKGNLTPYEWLDGKNNSEHWQNFVARVQTSGFSHTKKQRILSHKLDEKGFIERNLNDTRYVARFLCNFIADNMLLTGKGKRKVFASNGQITALLRGRWGLQKVRDDNDRHHALDAVVVACSTVVMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLSDLERMVNREREVTLYESLKARLEQFGNDPAKAFAEPFHKKGGAVVKAVRVEQTQKSGVLVRDGNGVADNASMVRVDVFTKGGKYFLVPIYTWQVAKGILPNKAVTANVDEIDWLEMDESYQFIFTMYPNDLVKVKLKKEEFFGYYGGLDRATGAIVIKEHDLEKSKGKQGIYRIGVKLALSFEKYQVDELGKNIRPCRPTKRQHVR

SEQ ID NO: 534 - protein, 1054 aa, Artificial Sequence
  Cas9
MKEKYILGLDLGITSVGYGIINFETKKIIDAGVRLFPEANVDNNEGRRSKRGSRRLKRRRIHRLERVKLLLTEYDLINKEQIPTSNNPYQIRVKGLSEILSKDELAIALLHLAKRRGIHNINVSSEDEDASNELSTKEQINRNNKLLKDKYVCEVQLQRLKEGQIRGEKNRFKTTDILKEIDQLLKVQKDYHNLDIDFINQYKEIVETRREYFEGPGQGSPFGWNGDLKKWYEMLMGHCTYFPQELRSVKYAYSADLFNALNDLNNLIIQRDNSEKLEYHEKYHIIENVFKQKKKPTLKQIAKEIGVNPEDIKGYRITKSGTPQFTEFKLYHDLKSIVFDKSILENEAILDQIAEILTIYQDEQSIKEELNKLPEILNEQDKAEIAKLIGYNGTHRLSLKCIHLINEELWQTSRNQMEIFNYLNIKPNKVDLSEQNKIPKDMVNDFILSPVVKRTFIQSINVINKVIEKYGIPEDIIIELARENNSDDRKKFINNLQKKNEATRKRINEIIGQTGNQNAKRIVEKIRLHDQQEGKCLYSLESIALMDLLNNPQNYEVDHIIPRSVAFDNSIHNKVLVKQIENSKKGNRTPYQYLNSSDAKLSYNQFKQHILNLSKSKDRISKKKKDYLLEERDINKFEVQKEFINRNLVDTRYATRELTSYLKAYFSANNMDVKVKTINGSFTNHLRKVWRFDKYRNHGYKHHAEDALIIANADFLFKENKKLQNTNKILEKPTIENNTKKVTVEKEEDYNNVFETPKLVEDIKQYRDYKFSHRVDKKPNRQLINDTLYSTRMKDEHDYIVQTITDIYGKDNTNLKKQFNKNPEKFLMYQNDPKTFEKLSIIMKQYSDEKNPLAKYYEETGEYLTKYSKKNNGPIVKKIKLLGNKVGNHLDVTNKYENSTKKLVKLSIKNYRFDVYLTEKGYKFVTIAYLNVFKKDNYYYIPKDKYQELKEKKKIKDTDQFIASFYKNDLIKLNGDLYKIIGVNSDDRNIIELDYYDIKYKDYCEINNIKGEPRIKKTIGKKTESIEKFTTDVLGNLYLHSTEKAPQLIFKRGL

SEQ ID NO: 535 - protein, 1054 aa, Artificial Sequence
  Cas9
MENKNLNYILGLDLGIASVGWAVVEIDEKENPLRLIDVGVRTFERAEVPKTGESLALSRRLARSARRLTQRRVARLKKAKRLLKSENILLSTDERLPHQVWQLRVEGLDHKLERQEWAAVLLHLIKHRGYLSQRKNESKSENKELGALLSGVDNNHKLLQQATYRSPAELAVKKFEVEEGHIRNQQGAYTHTFSRLDLLAEMELLFSRQQHFGNPFASEKLLENLTALLMWQKPALSGEAILKMLGKCTFEDEYKAAKNTYSAERFVWITKLNNLRIQENGLERALNDNERLALMEQPYDKNRLFYSQVRSILKLSDEAIFKGLRYSGEDKKAIETKAVLMEMKAYHQIRKVLEGNNLKAEWAELKANPTLLDEIGTAFSLYKTDEDISAYLAGKLSQPVLNALLENLSFDKFIQLSLKALYKLLPLMQQGLRYDEACREIYGDHYGKKTEENHHFLPQIPADEIRNPVVLRTLTQARKVINGVVRLYGSPARIHIETGREVGKSYKDRRELEKRQEENRKQRENAIKEFKEYFPHFAGEPKAKDILKMRLYKQQNAKCLYSGKPIELHRLLEKGYVEVDHALPFSRTWDDSFNNKVLVLANENQNKGNLTPFEWLDGKHNSERWRAFKALVETSAFPYAKKQRILSQKLDEKGFIERNLNDTRYVARFLCNFIADNMHLTGEGKRKVFASNGQITALLRSRWGLAKSREDNDRHHALDAVVVACSTVAMQQKITRFVRFEAGDVFTGERIDRETGEIIPLHFPTPWQFFKQEVEIRIFSDNPKLELENRLPDRPQANHEFVQPLFVSRMPTRKMTGQGHMETVKSAKRLNEGISVIKMPLTKLKLKDLELMVNREREKDLYDTLKARLEAFNDDPAKAFAEPFIKKGGAIVKSVRVEQIQKSGVLVREGNGVADNASMVRVDVFTKGGKYFLVPIYTWQVAKGILPNKAATQYKDEEDWEVMDNSATFKFSLHPNDLVKLVTKKKTILGYFNGLNRATGNIDIKEHDLDKSKGKQGIFEGVGIKLALSFEKYQVDELGKNIRLCKPSKRQPVR

SEQ ID NO: 536 - protein, 1055 aa, Artificial Sequence
  Cas9
MNNYILGLDIGITSVGYGIVDSDTREIKDAGVRLFPEANVDNNEGRRSKRGARRLKRRRIHRLDRVKHLLAEYNLLDLTNIPKSTNPYQIRVKGLNEKLSKDELVIALLHIAKRRGIHNVNVMMDDNDSGNELSTKDQLKKNAKALSDKYVCELQLERFEQDYKVRGEKNRFKTEDFVREARKLLETQSKFFEIDQTFIMRYIDLVETRREYFEGPGKGSPFGWEGNIKKWFEQMMGHCTYFPEELRSVKYAYSAELFNALNDLNNLVITRDEEAKLNYGEKFQIIENVFKQKKTPNLKQIAKEIGVSETDIKGYRVNKSGKPEFTQFKLYHDLKNIFEDSKYLNDVQLMDNIAEIITIYQDPESIIKELNLLPELLSEKEKEKISALSGYAGTHRLSLKCINLLLDDLWESSLNQMELFTKLNLKPKKIDLSQQHKIPIKLVDDFILSPVVKRAFIQSIQVVNAIIDKYGLPEDIIIELARENNSDDRRKFLNQLQKQNAETRKQVEKVLREYGNDNAKRIVQKIKLHNMQEGKCLYSLKDIPLEDLLKNPNHYEVDHIIPRSVAFDNSMHNKVLVRAEENSKKGNRTPYQYLNSSESSLSYNEFKQHILNLSKTKDRITKKKREYLLEERDINKYDVQKEFINRNLVDTRYATRELTSLLKAYFSANNLDVKVKTINGSFTNYLRKVWKFDKDRNKGYKHHAEDALIIANADFLFKHNKKLRNINKVLDAPSKEIDKKRVTVQSEDEYNQMFEDTQKAQAIKKFEIRKFSHRVDKKPNRQLIKDTLYSTRNIDGIEYVVESIKDIYSVNNDKVKTKFKKDPHRLLMYRNDPQTFEKFEKVFKQYESEKNPFAKYYEETGEKIRKFSKTGQGPYINKIKYLRERLGRHCDVTNKYINSRNKIVQLKIYSYRFDIYQYGNNYKMITISYIDLEQKSNYYYISREKYEQKKKDKQIDDSYKFIGSFYKNDIINYNGEMYRVIGVNDSEKNKIQLDMIDISIKDYMELNNIKKTGVIYKTIGKSTTHIEKYTTDILGNLYKAAPPKKPQLIFKRGME

SEQ ID NO: 537 - protein, 1055 aa, Artificial Sequence
  Cas9
MTPISESLLFGLDVGISSCGWAVLKHSDTTGHIEALGSWCFNAPETKTERTPTNQIRRSSRLLRRVVRRRRNRMTEIRRLFARHGLIDNDRPDALRQPAIDPWEMRGQGLDRQLTPEEFAVALAHIAKHRGFKSSAKRVKSNASPDDSKMLAALEKTKELSAQYRTIGEMFARDSAYVQRRRNRDGLFDRTISRDDLIDEAKILFDRQRKLGNPVASTEIEEAFTRIAFWQNPMQDSGVLVASCPFEPKEKRSSRFSPSFERFRLLCRLINLRVTDGPEERPLTEEELRLAYEHAGKTRKLTAAAIRKLIGLRDDQHFTTIPPEQEKQDITSRTGETFAGTATFRSVLGESLWRQLLPHPEWLDNAAWIISFHELTETIIKKLGEIGLPVEAYELICDALKSDKSPFAKFKGASSLSDKAVRALIPYLQQGLTYDKACQKAGYDHAASRFSGRATIDTKAKFNALMAEVRDSIANPIARKALSEGMKQLWAMRNRWGLPGAICIELARDVGNSLEKRKEIERNLKTTAKQRAREREEACELLNLKEVSSDILLRYRLWKEQGGRCCYSGKSITPDMLMAQDNRIQIDHILPWSRFGDDSYSNKGLCLAKENQAKKNQTPYEWIHGQGTTAQKEQWDKFVADVESRKNTKGLKKRNFLLKGSKEIEERFRSRNLNDTRYAARLMVEAARLLYPAGQRGEKGGTRRVFTRPGALTAALRHAWGVESLKKIDGERLHDNRHHALDAAIVAAVSEAEIQKLTKSFQECEQKGLSRPMRDVAPPWDGFRDQLKEKYETIFVARPERQRARGQGHEATIRQVREEETGPVIYERKAVSALTLADLAKIKDPDRNAGLIASLRQWIEAGKPADKPPRTPCHQSAAGHEIRKVRLATIITPAVPVRGGMAKRGEMTRVDIFKVIGKKGKPEWYMIPIYPHQIMNRSQWPAPPNKAVVAGKSEADWPIMGAEAQFQFSLYPCSYVRLFKEGTVIEGYFCGCHRSRAYITLALSTGAAPLQKGIGIKTQEHIQKFSVNRFGELSPVKQETRTWHGVACTSPDQHD

SEQ ID NO: 538 - protein, 1056 aa, Artificial Sequence
  Cas9
MKALNYILGLDLGIASVGWAVVEIDQNELPIRLIDLGVRTFERAEVPKTGDSLALARRLARSSRRLVRRRAVRLLKAKRLLKQEGILQADDFHSSHLKPLPNNPWELRVKGLNHLLDRKEWAAVLLHLLKHRGYLSQRKNESKTDNKELGALLKGVSENRQLLQAQAFSTPAEIAIKKFQQEEGHIRNQRGAYSHTFDRNDLLAELRLLFQKQREFNNPYTSQSLEQAIAELLMWQKPALSGEAILKMLGKCTFEPSEYKAPKNSYSAEYFVWLTKLNNLRILENGADRGLTAEERQLLINQPFEKAKFTYAQARKLLELSDLAIFKGVRYGKDNAESATLMEMKAWHAIRKALESNGLKTEWNGLKTKPELLDKIGTAFSIYKTDEDISQYLNGELSPAVLNALLENLSFDKFIRLSLQSLAKILPLMEQGLRYDEACKQVYGDHYGKKEQLELRFLPKIPVEDIRNPVVLRTLSQARKVINGVVRLYGSPARIHIETGREVGKSFSERRDISKRQEENRNERQRAVEKFKEFFPHFVGEPKAKDILKMRLYEQQHGKCLYSGKELDLNRLLEKGYVEIDHALPFSRTWDDSFNNKVLVLASENQNKGNQTPYEWLNGKENAERWKLFQALVNGSRFPYSKKQRILTKYLDEDGFRERNLNDTRYVARFLCNFIEDNMQLVGQGKKRVFASNGQITALLRRSWGIQKVREDNDRHHAVDAVVVACSTRALQKKITDYVRYKEMNVFTGEKIDQETGEIIKFHFPEPWKFFRQEVEIRVFSETPAEDVVIALPDRPQANHEFIQPLFVSRAPTRKMTGQGHMETIKSAKRLAEGLSVSRVPLTQLKLKDLENMVNREREKALYEALKVRLEKFNNDPAKAFADPFYKKGGQQVKAVRVEQVQKSGVLVRQENGVADNASMVRVDVFIKGGKYFLVPIYTWQVAKGILPNRAATQGKEEEYWDIMDETAIFQFSLYQNDLIKLVTKKKTIFGYFNGLNRATSNINIKEHDLDKSKGKDGIYLEVGVKLALSLEKYQVDELGKNIQPCRSMKKRPPVR

SEQ ID NO: 539 - protein, 1056 aa, Artificial Sequence
  Cas9
MPKQKSTRYRLALDLGSTSLGWAVLRLNEQHEPNAIIRAGVRIFSNGRNPKDGSSLAVTRRAARAMRRRRDRLLKRKARMMNKLVEYGFFPADVAERKKLERINPYELRAKGLDAPLTPGEFARALFHINQRRGFKSNRKTDKKENDSGALKAAISHLRQQLHERKARTVGEWLWQRLQAGLGTRARYRESRVAQANGKTRIEKSYDLYVDRQMIAEEFDALWAAQAAFNPQQFSEQARGELRDVLLFQRDLRPVRPGRCTLLPDEERAPLALPSVQRFRILQEANHLRLLHPDLREEPLSLAQRDAVVDALEHNSKRTFEQLRKLLKLNGTVKFNLEDEKRKELKGNATSATLSKDGLFGENWWNLDEALQDAIVWQLVSEQSEEKLQNWLQANTGVNATQAETIANAGLPEGYGSLSYKALARIIPALRGTEVANGIDVPRTYDQAVQAAGFAHHSDLDSGFDFEHSHDEVERIGERVIASTGEVKPVFAFKQLPYYGKALRRHVAFAKEHPRNEEERYGKIANPTVHIGLNQLRVVVNALIRRYGRPTEVVVELARDLKQSREQRQEEQKRQADYQKRNEHIRREIASMHGCAEERVSHADVQKWILWEELSFDVADRRCPYSGVQISAQMLLSNQVEIEHILPFSQTLDNSLNNRTVAMRQANRIKGNRTPWQAREDFERQGWSYDSILQRAERMPKAKRYRFSRDGYERWLKEDKDFLARALNDTRYLSRVAKTYMELVCPLGTRVIPGQMTALLRAKFGLNDVLGLNGEKNRDDHRHHAVDACVIGVTDQGLLQRFAQASADARGNGLEKLVENMPVPWATYRDHVKRAIQCIWVSHKPDHGYEGPMMEETAYGIRKDGSIRQKTKADGSTGREITHLIRITEPTQNLRHGVDAQGQPLAYKGYVGGSNDCIEITQNEQGKWEGNVITTFQAYDIVRRLGSKQGPRRLRHPTLAQTLDVYGKPKKLVMRLMIDDCVRLELDGNKKTLRVVKITGNGQVFMAPVHEANVDKRNSDKTDPFAYVSKYAGSFQKAKARRITISPIGELHDPGF

SEQ ID NO: 540 - protein, 1057 aa, Artificial Sequence
  Cas9
MSDKSKILGFDIGITSIGWAYVEGEELIDCGVRIFTKAENPKTKESLALPRREARGVRRRLARRKGRLNAIKQLICKEFGLNYQDYIAQDGELPKAYAGKLINPYELRSKALREKLEKEELARVILHIAKHRGYGNKHAKETDDAESGKIKKAISNNEKILNEKGYQSAGEYLYQEFFQKERLQEEKKGNNTTKEFKNVRNKAGDYEHCIAQTQMQNELRLIFEKQREFGLNFSEEFKKKVLETAFFQRPLKDFSDKIGDCTFIEGAKRAPKDSLSAIEFVALGRIINTLKNLQNTSGEVYSRDKINEILQIVLDKGEISYKKLREILDIESSVRFKDSKLDYTKELKEAEKTKLFESKNLQKFKKALGSFEGISREILDSIAKEIMITKDKEKLAKELKKFPLDETQIQNLSNLSFSQTINLSLEALSQILPFMRGEREDKCLRYDEAVEKAGLKEVAKNKSKDDFLPPLENYEPYLANPVVARALSEYRKVLNALLRKYGKMHKIHIEFTREVGKSKEERNKIEKEQKENFAKNQEAQKQCEILGLPINGANILKMKLWREQQESCVYSGKEIAIDDLKNPAILQVDHIYPYSRSFDDSYNNKVLVFSKENQNKLNKTPFEAFGENKDKWEKILSLASKLPKPKRQRIYNMQFKDKEQGFLTRNINDTGYIARLVSQWTKNCLSFEKLSEDEVSIAGEKGSKVHVEVISGSLTAMLRHYWGLGDKNRDNHLHHAVDAIIIAYSNEKVIKAFSDYKKHREQNKAKFYAKEIAESEYKKQKVFFEPTNHFRQKVLEKIDSIFVSKPPRKRARGALHEETFYSFERLCNDKEYAKKEKMDYGGKAGIQKAIALGKIRQVGTKIVSNGTMVRVDIFQHKSNGKFYGVPIYTMDFALGVLPNKAVVSGKDKQGVIKDWLEMDSNYEFCFSLFKDDLILVQKKEMEKAELCYYTDFNSNTAGIKFEKHNNLYVNLNENERKLFTSKEVVKGGKKNVWKDKTPKEIEQLEKNRKIIGGFVTIEDLKTFEKYQVSPLGEVQKADFAPRQAITLKSSPKHRINK

SEQ ID NO: 541 - protein, 1057 aa, Artificial Sequence
  Cas9
MSNRVPYRLALDLGTNSIGWCLLDLNGNGDPCGVRRMGVRIFPDGRDPKSKESLAADRRLARSMRRRRDRYLRRRSALMNALVAAGLMPADRATRKALESEDPCELRARALFEPLTAGQVGRALFHLNQRRGFKSNRKAAGEENEAGKIKAGISALKAEIEASGETTLGAWLAARHRKRETVRARLDGAGAKASYEFYPERGLVHDEFQAIRTAQALHHPAVTAEQWDRVESVIFRQRPLRPVRPGKCTLFPDQERAPWALPVAQEFRILTEIGNLKLYRPGEEPRELSADQHAQLFAKLCRSADLTFEKIRKELKLDPGLKVNLEGEKRDRLKGDAVTSALSAKKRFGPKWNALTPDDRRDIVGRLIEAEDEAELAGWLESVHGLPSENAAHTAASPGLPDGYCRLSEKALVKLVPLMREQRLRYDEAVLALNLHHSDFRPEGLLDELPYYGEPLERFIAFGSGEPSDPPEQHLGRFPNPTVHIGLNELRKLVNRIVERWGKPADIVVELARDLKRSRDERDTIQREQAQNQRKNEDRFAKIKELGIDPRPDSMLRLRLWEELPKVGVGHVCVYTGEPIGIRRLLEGDVDIDHILPFSRTLSDGADNKIVCVRRANRFKRDRSPWEAFGVTAVDGYDWAAIAQRAEELPKNKRWRFLPDAMDRFEGERGFLDRQLVETRHLSRVARQYLASIVDLNKVRVAPGKLTAMLRARWGLNKILSDGNLKNRSDHRHHAIDAAVLGMIDQRLVQLVAQAAARAEANELERLFDGLPDPFDGLAATSFGDQVREKIRGITVSHRAEHGWQGRMHNDTAYGPVEAVNGVHTVVTRKPLSGLTAKDFPNIRDRVLAKALEDHVAAEAAAGRSFGDALGSFKWGGQPVRRVRMLDVLGNPIPIQDPSGTVFKVYKGDSNAWYEILRDPRGRWTGKIVSTFEAYRLHREWLAETGGDSGRGSGVFLDWAAKRVVGEAGTPLFRLFKGDLLALGEAPDRRIVRVVKFSEGQVALALHLEAGNLKARDADKGDPFKYQYCSPDSLRKQAARPAGVDLLGYVHDKGPLE

SEQ ID NO: 542 - protein, 1057 aa, Artificial Sequence
  Cas9
MRRLGLDIGTNSIGWCLIEDDKKIVDIGVRIFSDGRDPKSGASLAVDRRDARAMRRRRDRYLGRRSAFLQALVVHGLMPADADEAKLVADRDPYQLRAKALHVALEPFEIGRALFHLNQRRGFKSNRKADRKANAGEDGKIAEGAKALDQAMSEAGVDTLGQFLALKETKRVRLGSDGQAYDFYPQRRHIEYEFDRIWKVQSEYHPALLTEAARAALHRILFFQRPLKAQEVGFCTFAGVNGIAANERRLPKAHPLFQQRRLYEEVNQLRIVSAGAADRPLTLDERDRLILRLQDRKKVSFDTLAKKDLRLADGERFNKESENRKELIGDEVRAEMSDKKRFGTRWVHFGLDEQLRILAKLQDEENPEALLDWLRSEYGLDEAAAESVANARLPEGYGRFGETATRLLLDALKAEVITYDKAALRAFGHHSDFRTGEVLDRLPYYGELLTREIAPGKPEYGDPLERQYGKITNPTVHIGLRQLEKLVNAVIAVHGRPDQIVVELARELKLNEKEKDEHKRRIKRDTDAAIARGRKLASEGFIDNGANRMLMRIWEELNPANPLDRRCPYCAEPIGIRALFSGEADIDHIIPYSRSLDDNVGNKVVAHRSCNRAKGNKTPYEKWGPHIDPERWERISDQVARLHKSKQWRFGPDAMERIDRDGGFLARQLTDTQYLSRVAGKYLRSLYPTAQSGRVDVIPGRMTAMLRRKWGLNSLLPDHNYVENEHSNAPKNRLDHRHHAIDAAVAAVTTLSLMQQIADAAGRAEDKNLDRLFEDIPQPWPGFREELGEALRSTTVSHKADHGRKRRPSRDRDVTAARLHNDTAYGLTGDVAADGKTPIVVHRVPLASLKPADLIDPLRIPDPVLRDALYAATRDRTGKEFEQALTQFARHHPLFKGIRRVRVREPLNVIPIRDAAGRAYKAYKGDANARFDVWRLPNGKWVSDIVSMFDAHCMADKSDRRPHPAAKKVLSLRQNDMVAIERSGVTQIARVVKFSTNGSIALAADNEAGALKARDAAPNDVDPFKYIFSSGGGLKNLKARQVRVDPLGRVFDPGPRE

SEQ ID NO: 543 - protein, 1058 aa, Artificial Sequence
  Cas9
MKNSYILGLDVGIASVGYGLIHSDSKSVIDAGVRLFPEANVENNEGRRAKRGSRRLKRRRIHRLDRVKYLLAQYHLIIDDKIPKSTNPYAIRVKGLSSALSKSELVIALLHLAKRRGIHNVNVVMDENESTNELSTKEQLKENAKQLENRYVCELQLDRLNEQYKVRGERNRFKTEDFVREARQILTTQQKYHDIDEHFIEQYTHLLETRREYYEGPGKGSQYGWEGDLKQWYEMLMGRCTYFPEELRSVKYAYTADLFNALNDLNNLVIARDENEKLEYFEKYHIIENVFKQKKSPTLKQIAKEIDVKESDIKGYRITKNGKPQFTSFKLYHDLNKIFLDKKNLENIELLDEIAFILTLYQDPLSIKEALDQLQDLLTESEKEAIAHLNGYTGTHRLSLKCLHLLIDEMWQTSRNQMEVFTALNLKPQKYQLSKQKQIPKKMVEEFILSPVVKRSFIQSIEIVNTIIKKYGLPEEIIIELAREKNSEDRRKFLNRIQKENENTRKQVEEVIREYGNRNAKGLVEKIKLHQMQEGKCLYSLQNIPLDDLLRNPSHYEIDHIIPRSVSFDNSFNNKVLVKQEENSKKGNRTPYQYLNSNESVLSYVQFKQHILNLSKSKERISKKKREYLLEERDINKFEVQKEFINRNLVDTRYATRELVQLLKSYFSANDLDVKVKTINGSFTNYLRKAWKFDKSRNKGFKHHAEDALIIANVSYLFKQSKELKEANAILENNNLSLNKNKDSKNLLTEQDYRKMFEIPKQVQDIKDYKDFKYSHRVDKKPNRQLINDSLYSTREVNENHYIVQTVKDIYAKDNTKIKDLFLKTPEKLLMYQHDPQTFEKLMLVIKQYGEEKNPFAKYYEENGEYLTKYAKNEKGPTIKRLKYIGKKVGTHLDISTNFSGAKRKVVQLSIKPFRFDVFHSKAGYHMLTLTYMDIKKKEKHYQILKNEYQALKERYKVPSDAQFIGSFYYNDLISINDELFRVIGVNNSTRNVVELNMVDINYKDYCDLMGIKKTPRIFKTITKKTGKIEKYSTDILGNQFKVKPSKSPQLIFKRGVL

SEQ ID NO: 544 - protein, 1059 aa, Artificial Sequence
  Cas9
MRRLGLDIGTNSIGWCLTQGPGDEADGIVDIGVRIFSDGRDPQSGTSLAVDRRDARAARRRRDRYIGRRSAFLDTLVAHGLMPADADEAKLVAALDPYTLRARALEAPLTPHEIGRALFHLNQRRGFKSNRKAERKTNDADDGKIATAAYALDRAMLDGGFDTLGQFLNAQETKRVRMDGEAQGYDFYPQRRHVEYEFDRIWTEQAKHHPALLTETARYALHRILFYQRPLKAQVVGKCTFVHSEDRLAKAHPLFQQRRLYEEVNQLEVTTPGEANRKLTLDERDRLVRELSHKKAIAFTSLAAKIKLEPGQSFNKASETRTQLAGDEVRAVLGDKKRFGPAWEHFDRDRQWTIVERLLEEEDPDALHAFLTQDCGLDDEHAAATAKTSLPEGYGRLGATATARILAELQAEVITYDEAVRRCGWHHSDHRTGEILPQLPYYGELLTRDIPPGTQDPNDPPEKRWGRITNPTVHIGLNQVRQLVNAIVAVHGRPDQIVVELARELKLNEKDKEEHNRRIRRDTAAAIKRSEKLTQEGFPDTGANRMLLRLWEDLNPANPLDRRCPYCGAPIGMRALFAGEADVDHIIPYSRSLDDSAGNKVVAHRSCNRAKGNRTPYEKWSDDPDRWDAITAQVARLHRSKQWRFGPDAMARVEKDGGFLSRQLTDTQYLSRLAGRYLSSLYPTKEEGSVYVIPGRMTAMLRRLWGLNDILSDHNIVENKHSNAPKNRLDHRHHAIDAAVVAVSTRSLMQRIARTAGQAEDRNLDRLFEGLDPPWPGFRDQLRDRLLAVTVSHKADHGRTGTPVPGKDATAGRLHNDTAYGLTGETSAKGLPIVVHRVPLTSLKPADITDPDRIPDPVLRDAIERATAGKMGKDFTDALAKFGRSGAQETDRKGERLFRGTRRVRVREPLGVIPIADASGRVYKAYKGDSNARFDVWRLPDGKWVSDIVSMFDAHRPDQGDRRPHPAAKKVLSLRQNDMIAIERDGAPREIVRVVKFSTIGSVQLAATTEAGPLKARDASPPDVDPFRYINSSAGGLKKIKARQVRIDPLGRIFDPGPR

SEQ ID NO: 545 - protein, 1059 aa, Artificial Sequence
  Cas9
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 546 - protein, 1059 aa, Artificial Sequence
  Cas9
MSKRLRYRLALDLGTNSIGFCLLDLNGDGRPCGVRRMGVRIFPDFSKLQQSLAADRRLARSMRRRRDRYLRRRKALMNALVAAALMPADPKARKALEALDPYELRAAAVAGPLPAHQLGRALFHLNQRRGFKSNRKAAGDENEAGKVKSGISALKAELAASGAGTLGQWLAARHANRQPVRARLTGTGAKATYSFYPERALVHEEFQAIRAAQAPHHPGVTAEQWDRIESVIFHQRPLKPVKPGKCTLYPEEERAPWALPIAQRFRILHELHNLRIVRPGQGEEGLSPADFDRFFDRLCRKGDLTFKTLAKELKLPPDARINLEDDKRDRLKGDATADALSAEKGKRRRIGAAWHSFPADRQREIVGRLIDAEDEGELAAWLVEELGLPWEVAILTAERPGLPDGYCRLSEKALEQVVPLMHEEHLPYDEAVRALGLHHSDHRTGEFLDELPYYGLPLERFIAFGTGEADDPPELRIGRFPNPTVHVALNELRRVVNRIIRRWGKPEEIVVELARDLKQSRADRDKTQREQADNQKKNWTRTQQLRELGMEPTGEALLRLRLWEELPRIGSAHVCVYTGQPISMTQLLQGDVDVDHILPFSRTLANGADNKIVCHRRANRIKRNRTPWEAFGVVSADGYDWAAIAERAESLPKNKRWRFLPNAMERFETERGFIDRQLVETRHLSRVAREYLGCIVPLEKVRAAPGRLTAMLRGRWGLNSILSDANLKNRSDHRHHAVDAAVLGVIDQRLVQRVADAAKRAEEKELEKLFDGLPDPFEGLPGPSFRDQVQERAQGIIVSHKPEHGWQGRMHNDTAYGPVERLPDGTHRVVTRKPLGSLAEKDFGNIRDRALAAALERHVAEQAAQGRSLGEALSCFTWTGGEVRRVRMLDKLGSPVAVQDDDGHTFKLYKGDSNAWYEILRDGRGRWTGRIVSTYEAYRLHAEWLAERGDGGRSDAAFPDWAARRLCAGIGKPLFRLFKGDMLAFGTAPNREIMKVVKFSEGRIVFAGHREAGNLKERDADKDDPFKYRTCSPEALRKAQARPVGVDPAGFVHDRGPLE

SEQ ID NO: 547 - protein, 1059 aa, Artificial Sequence
  Cas9
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 548 - protein, 1060 aa, Artificial Sequence
  Cas9
MAVKSLNYILGLDLGIASCGWAVVEMDEQENPLRLIDVGVRTFEEAENPKDGSSLAETRRLARAQRRLISRRANRMNKLRRLLKQENVLQANDYDEKGLIIGLPNQAWELRAQGLDRKLEPKEWAAVLIHLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATLMEMKSYHAIRKSLENKSLKSEWEKLKTQPKLLDLIGTAFSIYKTDDEIAGCLKNQLPENVIIALQEQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEYLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNHAVVHSKDESDWILMDESYHFKFALYKNDLLEVQTKKGCIMGYFASLDRATGAITIREHDRDKKKCKDGEHRSIGVKMASSFKKLQVDELGKNIHETRSRKRPNIG

SEQ ID NO: 549 - protein, 1061 aa, Artificial Sequence
  Cas9
MHTLPYTLGLDIGIASVGAALLSDESILGMHVRTFSAAETDKEGDPLNKIRREARSARRRIRRRAHRLLRLRRLLKRTGLISDTSLEVLKTSKTPWQLRSEGLDRLLSPSELAAALYHIVKHRGFQSNRKAELKTDAKAGQMLSGVSANQQLMRDKSYRTIAEMVCKDDAFKDHKRNKGGSYRNTFARSDLADELKTLLKKQREYDNPLATPELEEAVHTLLMARRPVFKDDDIEKLVGFCTFEHGEKRAPKAAFSSERFIWLGKLNNLRLIYPGEQRSLTPEERSQIINLPFTQASVKFSQIRKKLDLPEYVRFNLVRYKPGEETSKSETATFFEAKAFHELRKTYRESGISELWERDQHDPQRLDQIATAIAVYRDDERIRNELSPHTIENEVVEAVLNCDFTQFINLSLKALNKILPYMEQGQRYDEACTSAGYQHHSPQQNEEKSGRIPPPDKNVIRNPVVYRSLNQARKLINAITKRYGAPAAIHLEMARDLSKPFSERKSIEREQEKYRKQKVQLRNEYIEHFGTEPNGLNLLKFRLYKEQDAQCAYTQKALDLSRLNEAGYVEVDHILPYSRSYDDSLLNKTLVLTEANRDKGNRTPFEFMGGDDQSQHWQKFVRWVQMNPKIRQAKRNRYLRKDFSEKAAREFRDRHLNDTRYIGRELKAMIESHVQWHPDSKSKDCCVVLSGQLTALLRGRWGFNKDRAAGDLHHAVDAAVVAAATRGMIQRMARHSKFHELKNVRTSYADPDTGEVVNLAAARDLEKHFPLPWDNFRNDTLAYLNPSAISADESAQEGHRGVRVSRAPTRRKLGAAHQETIRSKGKDNILLEQGLSAVKTPLSKLTLKNIENMVGYEDPRNAALVKVLRERLEAFGGDGAKAFAPNQPPVYKPSKPGKQAPEIRSVKMASKSKGALHVREGLADSGRMIRIDIYETKNGYVGVPIYVSDKARSKLPKAYPKKGEDRANWPEVDTNDNFLFSLYSTDWIEAKTKKETIAGYVKSYDIFDGRLLVYAHDNKKVVRKLTLSALADLQKLHVSILGDLYKGGTPKCSPLRKGQEL

SEQ ID NO: 550 - protein, 1061 aa, Artificial Sequence
  Cas9
MLRLGLDIGSTSIGWFLYRITNGMIAEIIDCGVRLFSDGRDAKTGVSSAVERRNARALRRRRDRYLRRRAALMRRLAAAGLMPEDPSQAKPLELLDPYRLRADALDRRLELTELGRALFHLNQRRGFKSNRQTDRGNNEGGKIIDGSARLDQAMMAVGARTYGEFLHLRRSQAEDLRRVPSVRTRLTLRSVDGGKAETGYDFYPDRRHLEEEFNKVWAAQAAHHPVLTDSLRHEVFETIFFQRPLKAPAVGRCLFFPEPRLPRAHPLTQRRVLYETVNALRIRTESGAAVPLGKEQRDKVIMLLDGKAPVKAIASAKLSLKAIAKHLKLRDGQTFTLEKGRDYIACDPVRASLSHPDRFGPRWSVLEAEVQAEIVGRIRDDDDTMALVEWLKQVHGLDDAHARATADAPLPEGYGRLGETATRKLLDCLKAEVLTYSEAVGKALDQHHSDRRTGEILESLPYYGEVLQAHVIPGTGEPHHDDITRFGRITNPTVHIGLNQLRRLVNRIIARYGKPAEIVVELARDLKQSTGQKKAAIALNLKNRKAAEARSALLTEWGVPDTGANRMYVRLWQELHEDPMMRRCPYTGTIISPSLLFSGAIDIDHILPYSRTLDDSTANRTLCMKEANRQKRNKSPSEARRDGMRIWALEDDNLRHIPEFKRWRFAEDAMARFEGERDFEARALVDTQYLSRISKAYLETLYDGADGKSHVWVVPGRLTEMLRRHWGLNGILTDPLRDVTKEKNRMDHRHHAIDAAVVAATDRGLIKAMAEQARTDVDQGREALASSIMPPWPGFREAVAAQVDRIIVSHRPDHGRIDLTTRMKGRDQTTGPLHRDTAYGLTGQSEKGVPLVVTREPFDNLTPTMIGKIRDEPLKAALAAVTAGKKDDAFAEALAHFRDRPGPYHGIRRVRLIEPISVVEIRDASGRAYKGYKGNSNHCFEVWRLPGGAITEHIVSTFDAHQPGPEPRPHPAAKRLLRLFKSDMVKLDDSKFGPVIATVVMFDRNGKISLVPHTASNARKRCEKYKEDLYLRFTARTLIEAGARRIIVDETGHFRDPGRKG

SEQ ID NO: 551 - protein, 1062 aa, Artificial Sequence
  Cas9
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 552 - protein, 1062 aa, Artificial Sequence
  Cas9
MNLNYILGLDLGIASVGWAVVEIDEQENPQRLIDVGVRTFDRAEVLKTGESLALARRLARSSRRLVKRRAERIKKAKRLLKAENLLLSADEILPNEAWQLRVKGLDQKLERQEWAAVLLHLLKHRGYLSQRKNESKSENKELGALLSGVAINHQILQSAEYRTPAEIAVNKFQAEEGHIRNQRGAYTHTFSRLDLLAEMELLFQRQATLGNPHTSTKLLENLTALLMWQKPALAGEAILKMLGKCTFEPTEYKAAKNSYSAERFVWLTKLNNLRILEQGAERALTDNERFALLDQPYEKAKLTYAQVRTLLGLSDEAIFKGLRYQGEDKKAVETKTTLMEVKAYHQIRKALEGLDLKAEWNELKNNPALLDEIGTAFSLYKTDDDIHRYLDGKLSESVLNALLENLNFDKFIQLSLKALQQILPLMLQGQRYDEAVSAIYGDHYGKKSDEIDRLLPNIPTDEIRNPVVLRTLTQARKVINAVVRLYGSPARIHIETGREVGKSYQDRKKLEKQQEENRKQRENAVKKFKEYFPNFVGEPKGKDILKMRLYELQQAKCLYSGKSLELYRLLEKGYVEVDHALPFSRTWDDSFNNKVLVLANENQNKGNATPYEWLDGKNNSEGWQHFVARVQTSGFSYAKKQRVLIQELDEKSFIERNLNDTRYVARFLCNHIADNMLLTGKGKRKVFASNGQITALLRGCWGLQKVRENNDRHHALDAVVVACSTKSMQDKITKFVKYKEGRLFKDKKDGVYKGERINRETGEIISLHFPTPWKFFKENVEIRIFSENPKLELENRLPDYPQYNHEFVQPLFVSRMPTRKMTGQGHMETVKSAKRLDKGLSVLKVPLTQLKLSDLERMVNREREMALYEALKECLEQFGNDPAKAFAEPFYKKGGALVKAVRVEQTQKSGVLVRNGNGVADNATGSIVRVDVFTKGGKYFLVPIYTWQVAKGILPNKAVIQGKDESEWEEMDENAVFQFSMHKNDLIKVKTKKGEIFGYFNGLDRATGSIEIEEHDLEKSKGKNGSHRGLGVKTAFFLEKYQVDELGKNIRPCRPTKRQHVR

SEQ ID NO: 553 - protein, 1063 aa, Artificial Sequence
  Cas9
MENHINYRLGLDIGIASVGWSVINLDKKRIEDLGVRIFNAAEHPKDGSSLALPRRIARGRRRLLRRKAYRVKRVRKLIVDYNILTKDQLNDLFKQKCQNSVWEIRVKALDNKVTNEEWARLLINLCKRRGFKSNRKNEADDKETKKVINSIKSNIKGMKESGSRTIGEYIYTQTLSSGDISKSFRNKDGQYNNCVSRKMIEEEIKILFKKQRELGCEFASEEIEEKYLAIFNSQRPFSKFEDLEKMVGFCTFEKASKERRAPKCSISAEEFVLYDNMNKLSILNKGDTRKLTNEERKIIVENAFKNKEIKYSKLRKILNLSNDERFSTLSYSNKTELSKTENSKFVALKGYHEIKSAIEKSFGKDTWNRVKNNRTMLNDIAYVLSIAKTDEDIIKQLSLRNIPREIIDAVLGLSFSKFSNLSIKAIEKILPYLKDGQQYNEACKSAGYDFKATYNGEKSYKLPLIDIDEIVNPVVNRALSQTRKVINAVIDRYGSPIGINIELARDLAKNFKDRSKIKKEQEENRANKEKIKNELKMLMNKEPTSSEILKYRLWKEQREECAYSQERIYIEDLFKVGQYEIDHIIPFSRSFDDSLNNKVLVKAAENQRKANRIPYEYFGSDEDRWYRFEVWVEQSSLSFKKKNNLLKKRFSREDSIEFKDRNLVDTQYISRYISNFIKSRLIFKESDSKQKVITINGRATSYLRAKWGLLKVRENGDKHHALDATVIAVATQGMVQEISKYSKAHELKYIRQGDEFIDIETGEIVKVKDHKHLSKDRLPEPWLGFSSELRLRLSENPIEELKKSPISTYDEEFIRKTVRPIFVSRVPYRKVTGRLFEETVYSPKAFIDEGFIAKKKLQDLTLKDFENIYNYNSDKKLYDALRERLEEYGGNAKKAFAEEFRKPTKTGKLGPIVKSIKVKTKIPFKDGIDLNGGKVKKDGLVRIDIYEKEGKYYVVPVYRLDIQQGNIPKKAAVANKEEKDWILMDESYNFKFSLYKNDLIYIKYDSKGEYFGYYDGFDRHTGAITLERHDNSERYRGIGIKTGVKEIFKYNVDVLGRYYKVAK

SEQ ID NO: 554 - protein, 1063 aa, Artificial Sequence
  Cas9
MEKFHYVLGLDLGIASVGWAAIEIDKETETSIGLLDCGVRTFERAEVPKTGDSLAKARREARSTRRLIRRRSHRLLRLKRLLKREIFRQPETFKDLPINAWQLRVKGLDSRLNEYEWAAVLLHLVKHRGYLSQRKSEMSETDSKSEMGRLLAGVAENHQLLQQEQYRTPAELALKKFVKHFRNKGGDYAHTFNRLDLQAELHLLFQKQRELGNPFTSPELERQVDDLLMTQRSALQGDAILKMLGHCGFEPEQFKAAKNTFSAERFIWLTKLNNLRIQDQGKERALTADERTKLLDEPYKKSKLTYAQVRKLLSLPQTAIFKGLRYDLEHDKKAENSTLMEMKSYHNIRQTLEKSGLKTEWQSIATQPEILDAIGTAFSIYKTDEDISHELKTCRLPENVLNELLKNINFDGFIQLSLTALRKILPLMEQGYRYDEACTQIYGNHHSGSLQQESKQFLPHIPIDDVRNPVVFRTLTQARKVVNAIIRRYGSPARVHIEMARELGKSKSDRDRIEKQQQKNKKERENAVAKFKEDFPDFVGEPRGKDILKMRLYEQQHGKCLYSGHDIDINRLNEKGYVEIDHALPFSRTWDDSQNNKVLVLGSENQNKRNQTPDEYLDGANNSQRWLEFQARVQTCHFSYGKKQRIQLAKLDDETEKGFLERNLNDTRYIARFMCQFVQENLYLTGKGKRLVFASNGGMTATLRNLWGLRKVREDNDRHHALDAIVVACSTASMQQKITKAFQRHESIEYVDTETGEVKFRIPQPWDFFRQEVMIRVFSDQPCEDLVEKLSARPEALHDNVTPLFVSRAPNRKMSGQGHLETIKSAKRLSEENSMVKKPLTTLKLKDIPEIVGYPSREPQLYAALKTRLETHDDDPIKAFAKPFYKPNKNGELGALVRSVRVKGVQNTGVMVHDGKGIADNATMVRVDVYTKAGKNYLVPVYVWQVAQGILPNRAVTSGKSEADWDLIDESFEFKFSLSRGDLVEMISNKGRIFGYYNGLDRANGSIGIREHDLEKSKGKDGVHRVGVKTATAFNKYHVDPLGKEIHRCSSEPRPTLKIKSKK

SEQ ID NO: 555 - protein, 1063 aa, Artificial Sequence
  Cas9
MEKDYILGLDIGIGSVGYGLIDYDTKSIIDAGVRLFPEANADNNLGRRAKRGARRLKRRRIHRLERVKSLLSEYKIISGLAPTNNQPYNIRVKGLTEQLTKDELAVALLHIAKRRGIHNVDVAADKEETASDSLSTKDQINKNAKFLESRYVCELQKERLENEGHVRGVENRFLTKDIVREAKKIIDTQMQYYPEIDETFKEKYISLVETRREYYEGPGKGSPYGWDADVKKWYQLMMGHCTYFPVEFRSVKYAYTADLYNALNDLNNLTIARDDNPKLEYHEKYHIIENVFKQKRNPTLKQIAKEIGVNDINISGYRVTKSGKPQFTSFKLFHDLKKVVKDHAILDDIDLLNQIAEILTIYQDKDSIVAELGQLEYLMSEADKQSISELTGYTGTHSLSLKCMNMIIDELWHSSMNQMEVFTYLNMRPKKYELKGYQRIPTDMIDDAILSPVVKRSFKQAIGVVNAIIKKYGLPKDIIIELARESNSAEKSRYLRAIQKKNEKTRERIEAIIKEYGNENAKGLVQKIKLHDAQEGKCLYSLKDIPLEDLLRNPNNYDIDHIIPRSVSFDDSMHNKVLVRREQNAKKNNQTPYQYLTSGYADIKYSVFKQHVLNLAENKDRMTKKKREYLLEERNINKYDVQKEFINRNLVDTRYTTRELTTLLKTYFTINNLDVKVKTINGSFTDFLRKRWGFKKNRDEGYKHHAEDALIIANADYLFKEHKLLKEIKDVSDLAGDERNSNVKDEDQYEEVFGGYFKIEDIKKYKIKKFSHRVDKKPNRQLINDTIYSTRVKDDKRYLINTLKNLYDKSNGDLKERMQKDPESLLMYHHDPQTFEKLKIVMSQYENEKNPLAKYFEETGQYLTKYAKHDNGPAIHKIKYYGNKLVEHLDITKNYHNPQNKVVQLSQKSFRFDVYQTDKGYKFISIAYLTLKNEKNYYAISQEKYDQLKSEKKISNNAVFIGSFYTSDIIEINNEKFRVIGVNSDKNNLIEVDRIDIRQKEFIELEEEKQVNYMNSDSYLKNNRIKVTIGRKTTNIEKFHTDILGNMYKSKRPKAPQLVFKKG

SEQ ID NO: 556 - protein, 1064 aa, Artificial Sequence
  Cas9
MSECVTRRILGIDLGIASCGWGVIEVGEASGSIIASGVRCFDAPLIDKTGEPKSATRRTARGQRRIIRRRRQRMNAVRRLLAEFGVLTGRSPDALHQALLRLSQSVAGSQVTPWTLRAAAHERKLTNDELAVVLGHIARHRGFRSNSKNDGGANAADETSKMKKAMETTREGLARYHSFGAMIASDPKFADRKRNRDKDYSHTAKRSDLEDEVRTIFRSQTRFGSLVASEKLSQAFADAAFFQRPLQDSEDMVGSCPFEPGQKRTARRAPSFELFRFLSRLANLKLTVGRAPERRLTPDEIALAAKGFGETKKSITFKSLREALDLDPNARFSGVAKEKESTLDVAARTGGAAYGTKTLKDALGDAPWRSLSRMPEKLDRIAEILSFREDMKAIRNGLEEVGLDGLVVDALMQATANGDFKDFTRAAHISALAARNIIPGLREGLVYSDACTRVGYDHAARPAVPLSQIGSPVTRKALSEALKQVRAVAREYGPIDYFHIELARSIGKSAEERKKLTDGIEARNVEKEKRRKEAAEHLGRAPSDDELLRYELAKEQNFKCIYSGDPIDPAGISANDTRYQVDHILPWSRFGDDSYVNKTLCTARSNQNKRGRTPFEWFDADKTEAEWMEYSARVEDLKEVKGRKKRNYSIKDAASVEDKFKARNLTDTQWATRLLADELKRMFPPRECERVVTVRADGGNDGLSIVEERRVFTRPGAITSKLRRAWGLEGLKKQDGKRVEDDRHHAVDALVLAATTESLLNRLTVEVQQREREGRQDDIFHCSQPWPGFRVDVQRTVYGSETMPGIFVSRAERRRARGKAHDATVKQIRDIDGERIVFERKPIEKLTDKDLERIPVPEPYGKAADPKKLRDELVENLRAWIAAGKPKDKPPRSPKGDIIRKVRIETKDKVAVEINGGTVDRGDMARVDVFRKKNKKGVWEFYVIPIYPHQIVASALPPNRAVIAYKAESEWTAIDGCFEFAWSLNPMSYLELVKSNGELIEGYFRSMDRTTGAINLSPMSTNSETIRSIGVKTLSSFRKFTVDRLGRKFEIPREVRTWRGEACT

SEQ ID NO: 557 - protein, 1064 aa, Artificial Sequence
  Cas9
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 558 - protein, 1065 aa, Artificial Sequence
  Cas9
MNKDINYALGLDIGITSVGWAVINLDLNRIEDLGVRIFNAAENLKDGSSLALPRRLARGRRRLLRRKAYRVERVRKLILKNNILTKEELEGLFKNKEVIDVWEARVKGLDYKLSREEWAKILINFCKRRGFKSNRKNEAKDKEAGQILSSISYNIEKMKETNSRTIGEYIYNEVKNSEDSYAPLRNKFGEYKMCVSRDVIREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEEELFSTLTYSIDKDISKTENTKFVSLKGYHEIKRAIEKGVSKKAWQDIENNRNLLNDIAYVLTLGKTDDEIEKQLRLRNVPEELFESLLDMSFNKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTVVEVLKYRLWEQQRGECAYTQSQIPLERLFSPGYCEIDHIIPFSRSFDDSLSNKILVLGSENQRKGNRTPYEYFGEDSERWNSFEIWVKGSYLNYKKKANLLKKKFSEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKSPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAVPFKDGIPMNEGLVAKEGMVRIDIYEKEGKYFVVPVYRYQLAKGIVPKRAAIAKKDELKWPIMDQTYNFKFSIYKNDLIEVKYDKKGVYFGYYDGFDRNSASLTIEKHDNSERYRSIGLKVGVLEINKYEVDVLGNYHKVKLGGN

SEQ ID NO: 559 - protein, 1065 aa, Artificial Sequence
  Cas9
MNKDINYALGLDIGITSVGWAVINLDLNRIEDLGVRIFNAAENPKDGSSLALPRRLARGRRRLLRRKAYRVERVRKLIVKNNILTKEELEGLFKNKEVIDVWEARVKGLDYKLSREEWAKILINFCKRRGFKSNRKNETKDKEAGQILSSISYNIEKMKETNSRTIGEYIYNEVKNSDDSYAPLRNKFGEYKMCVSRDVLREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEDELFSTLTYSIDKDISKTENTKFVSLKGYHEIKRAIEKGVSKKAWQDIENNRNLLNDIAYVLTLGKTDDEIEKQLRLRNVPEELFESLLDMSFSKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTAVEVLKYRLWEQQRGECAYTQSQIALERLFSPGYCEIDHIIPFSRSFDDSLSNKILVLGSENQRKGNKIPYEYFGEDSERWNSFEIWVKGSYLNYKKKANLLKKKFTEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKLPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAAPFKDGIPMNEGLVAKEGMVRIDIYEKEGKYFVVPVYRYQLAKGIVPKRAAIAGKSELKWPIMDQTYNFKFSIFKNDLIEIKYAKKDGYFGYYDGFDRHTASLVIENHDNSDRYRGIGVKTGVVEFNKYEVDVLGNYHKVNLGGN

SEQ ID NO: 560 - protein, 1066 aa, Artificial Sequence
  Cas9
MSERVVRRILGIDLGIASCGWGVVDISGAGGGIIATGVRCFDAPLIDKTGEPKSATRRTARGQRRIVRRRRQRMNGVRRLLCEFGLLPDPRPDALNQAMRRISTASAAAQVTPWTLRAAAHQRLLSNEELAVVLGHIARHRGFRSNAKNEAGANAADETSKMKKAMEATREGLAKYHAFGDMIANDPKFANRKRNRDKDYSHTAKRSDLEDEVRAILRAQLRFGSAAATETLAQTFADVAFFQRPLQDSEDRVGDCPFEPGQKRAARRAPSFELFRFLSRLANLKLAVGRSPERRLTAEEIALAAKGFGETKKTITFKSLREALDLDPNARFSGIGKDKEASLDVVARTGGAAYGTKTLKDALGDAPWRSLSRTPETLDRIAEILSFREDITSIRNGLEDLGLDSLVVEALMQAAANGDFKEFTRAGHISARAARNIIPGLREGLVYSEACARVGYDHAARLSVPLDQVGSPVTRKALSEALKQVRAVAREYGPIDYFHIELARSVGKSAEERKQLTDGIEARNVEKAKRRKQAEEHLGRAPSDDELLRYELAKEQNFKCIYSGDAIDPAGVAANDTRYQVDHILPWSRFGDDSYLNKTLCTARSNQNKRGRTPFEWFEADKTDVEWMEYVARVENLQEVKGRKKRNYSIKDAAAIEDKFKARNLTDTQWATRLLADELSRMFPPRECERAICGRADGGNDGLTIVEERRVFTRPGAITSKLRRAWGLEGLKKQDGKRVEDDRHHAVDALVLAATTESLLQRLTVEVQRREREGRPDDIFHCAEPWRGFRADVRRTVYGSETMPGIFVSRAERRRARGKAHDATIKQIREIEGERLVFERKPVEKLTDKDLEKIPIPKPYGQVSDPKRLRDELVESLRAWIAAGKPKDRPPLSPKGDVIRKVRIQTNDKVSVEINGGTVDRGDMARVDVFRKKNKKAVWEYYVVPIYPHQIVALNDPPDRAVIAYAEDKDWKEIDSSYEFLWSLFGLSYVEISKANGECIDGYFRGLHRGTGAASVCKHISLGKDATVSGIGLKTLASFKKFTIDRLGRKFEIPREVRTWRGEACT

SEQ ID NO: 561 - protein, 1066 aa, Artificial Sequence
  Cas9
MSHLVLGLDLGPNSIGWALVNDDPEHPVESKLVDLGVRVFPEGVDNFDTSKELSRNEDRRVARGMRRQIRRRARRRQQLKQALIDSKLWPSDPNDEVVLYNTNPYELRARALKERLEPHEVGRVLLHLNQRRGFLSNRKKDRGDKEVQGMLAEINENEQQCKDGGFDTIGAWLADKQANIDHANREENDHVRNRHLARSQYVDEFEAIWSVQAKHHPKLLTEELKVGKLGKQTYPVKPIPRWHEHRQGLSPLESFGIYGLIFFQRPMYWPKSVVGLCELEPKERRCQRSDRRQQRFRLLQEVNNLKYVDPDTHLEQKLDDKQRRLLLDKLSHTKEMTFDQIRKALDFLESVKFNLERGERSRLKGVPIDALFAAKDVLGQEWYDRPEQQKTEIVAVLLDNERDDDRIIARAVAEWGMTAKEAEAMLGVDLPAGYANLSCKAIEKLLPHMERGLLYMDDDESNSAMHAAGYLRRDQLRRRIFDVLPDPARTPNCPIGDIPNPVVKRTLTEIRKVVNAIVREYGKPDAIHLELARSVQMGKEKRSEYSKMIRDREAERDGIVEKLRESGVRVTRDNILKYQLWEQQNQECIYSGKPISFEKLFGEGGGVEVDHILPRSRSLDDSQANKIVCLRTANAGKGDQTPYEWLADTQPKQYEQVCQRAGMLMRSGRMPYAKYRRFIQRELELDKFIARQLADTGYITKATMEYLRYLFDKDHDVLGLKGQLTAELRYHWGLETILEELPDSPAWHEADSGKLRPGEKNRADHRHHAIDAVVIALTNRRRLVQLSDIVKRGGARAHGEILEDPWPNFRENVVQAIKKTNVSHRVERKVAGKLHEETLYGPTRTPGEWVLRKPVIALSANEVERIRDATIRQIVVSALADAGIDVGRGKKPDAKKMKEALSKLKMPSGVPIRKVRLTKPEQTIQPVRAGRPDQAFVKPGSTHHLCIFEFTENGKTKRDAVFVTMLEAMNRLKRREPVIQRTHPERPDSRFVMSLSAREMLLANWKDGERLLTFKTASSTQGQIWFAEHTDARKSADYKQFVANANTLDAKKVTVDPLGRIRWAND

SEQ ID NO: 562 - protein, 1067 aa, Artificial Sequence
  Cas9
MGTRLGLDIGTNSIGWCLFNLDGSGRPIGIRDIGVRIFSDGRDPRSGASLAVERRVARAMRRRRDRYIRRRSALLEALINTGLMPADVQESKALTGCDPYVLRAQALDRALDAHLLGRVLFHLNQRRGFKSNRKAERKAGDDKEGGKIADGAKALDLAMHEAGARTYGEFLAGRDSRRVRLRAEGDGYDFYPERRHLEAEFDAIWDAQAAYNPALLTDVVRDRLRRIIFFQRPLKAPKVGGCTFFNEEPRLPKAHPLFQERRLYEEVNQLEITRAGAPSRKLTLDQRDKIIRKLKSAKTASFSGLARLLKLADGESFSRVTENRTGLAGDDIFTSFSDKRCFGDRWAHFDPGVQWSIIETVTEEEDPVRLRDWLMATHGVTVEQAEAIGRVRLPEGHGRLGETASRLILAQLKSGSKDGHPLTYNEAVEAALGKSHSDFRTGEILEQLPYYGEILSREIPPGSLDPDDDDEIRWGKITNPTVHIGLNQLRRLLNALIKAHGRPDEIVVELARELKLSEKDKAEHNRRIGANTRAAEARSKKLLESGQPDTGANRSLLKLWEDLNPNNPLDRCCPFCGRHIGQMALFSGETEIEHIIPYSRSLDDSAANKVIAHRSCNREKGNRTPWEAWGHTERWAIIAEQVSRLHKSKQWRFAPDAIERFNQEGGFIARQLSDTQYLSRMARTYLSSLYPDTAGVYVIPGRMTAMLRRLWGLNELLPDHNYVENPHSGAPKNRLDHRHHAIDAAVVGVTTRGLLNEISRAAGRAERQDLDRLFIDLPKPWETFREDLHESLARVVGSHKADHGRKGVPAKGKDATAARLHNETAYGLTGLTSESGLPIVVHRVPLLSLKPDDLSNPIRIPDAALQRALREATDGKSGKDFQEALAQFSKSDPVFKGIRHVRVRETLKVIPIRDASGHAFKAYKGDANARYDVWRMPDGKWVSSWRDRDGKAHSGIITMFAAHQAGQPVQRPHPAAKRVLSLRQNDLVAVEPQGQPRKIMRVVKFSSGGQITFAEHQEAGPLKARDATSPDIDPFKYFYSSAGGLQKARARQIRIDELGRIFDPGPR

SEQ ID NO: 563 - protein, 1068 aa, Artificial Sequence
  Cas9
MKYVLGLDIGIASCGWAVINQEKHRIEDLGVRIFDKAENPKDGKSLATPRRDARSTRRTLRRKKHRMQRIKILLVKHGLLSKTEIDHLYESATEIDVWYLRLNALERRLNPKEFARVLIHLSKRRGFKSNRKETTLSENGQILENISENLQIMEQKNYRTVGEMILKDKRFENHKRNKDGTYIGTVTRQQLQEEIQMIFNAQRLYKNNHATEKFESSYLEIWASQRPYASKDQIEKMIGYCTLEPKEKRVPKASWSFQYFVALQTINNLRLISKDRIEELSFEEKKRIMNLALEKSIVKYIDIRKLLSVPKEFQFNSLSYSADIVDTTVENKKCIELKEYHSINKVYKQIYGQNALNLLPKDYDTIAYGLTIFKDDKDIQEYLQNKYVNAKGKPISNLANKTYDDTFIQVLLTLNFSKMGHLSFKALKNIIPFLEEGLSYDKACEKAGYNFKGTSYTKKTKYLPVIPQNTNPVVHRALSQTRKVINAIIKKYGSPNAIHIETARELSKTFQERKEIDSMYQDNSKKNEHAICKLKELGNINPSGINIVKFKLWNEQDGRCMYTGKYIEPHRLFEEGYTEVDHILPYSRSLDDSYNNKVLTLGTENQRKGNKTPYEYMRNNSIWDEFETRVQSNKKINKKKQQKLLLQNFSHAREQEFIERNLNDTRYATIYLSSLIQQHLIFSESSREKKVHTVSGIITSHLRSRWGFNKDRKEGHIHHALDAVIVAVTSDHMIQRVTKYYKLKELNRNRQAKRMQFPEPWEGFRLELEARISPNTQQYLKGIRFKNYADVNLSEIKPIFVSRMPKRSITGELHQETIRKFLGYNEKGKVLTATKTKLEDIPFDANGDFPMFGKETDLYTYNAIKERYLSHKKDKSKSFQEPLYKPTKSGGIGPLIKSIKIMDTRTIVNPVNQGKGVVYNSKIARTDVFKKGEKYYLIPIYTIDLMKNTLPQKAITAGKGYEDWTTIDPSFTFLFSLFPNDLIQIVPSKNKTIKARTTVSKKEVLLPSLTGYFKGVHSGTAGITVETHDGSIIANVGSKQLLSFEKYQVDVLGHYTKIKKEKRIGMAI

SEQ ID NO: 564 - protein, 1068 aa, Artificial Sequence
  Cas9
MNKAVAYRLALDLGSTSLGWAIFRLNEAREPTAIIRAGVRIFSDGRNANSEPLAVHRRVARAMRRRRDRLLKRKKRMHDQLVQHGFFPAEVAERKELERLNPYQLRAKGLHEALTPGEFARALFHINQRRGFKSNRKTDRKDNDSGALKQAISELRKRIQDSDCATAGEWFWKERMQQKPEGVRGQWVRARYRKTPSTTDEGKKRIGYDLYVDRAMVEQEFDALWAAQAALQPGLFTEAARAELKDTLLYQRDLRPVKPGRCTLLPAEERAPLALPSTQRFRILQEVNNLRLLDEALREVPLNLAQRDAVVSALEGKKELSFAAIRKLLTLSGKFNLEDEKRAELKGNATSVILARKDLFGDAWAGFDAAVQDEIVWRLVSQESEGALIAWLQQHTGVDGVCAEAIVNTRLPDGYGRLSRKALERIVPALQREVCTYDKAVQAAGFAHHSDLGFDFDYAEDEVQQVGEHTIASTGEVQAQYAFKQLPYYGKALQRHVAFGSGDAKDHEEKCYGKIANPTVHIGLNQVRTVVNALIRRYGHPTEVVVELARDLKQSREQKQQTQREQADNQKRNEDIRKRIAPILETSPERVRDRDIKKWILWEELNKKDIADRHCPYSGERISATMLLSEAVEIEHILPFSRTLDDSLNNRTVAMRRANRIKGDRTPWEARADFEAQGWRYEAILQRAEGMPPRKRYRFAEDGYQRWLGKDRNFLARALNDTSYLSRLAANYLRLVCPQGVRVIPGQMTDKLRGKFGLNSVLGLDGKKNRNDHRHHAVDACVIGVTDQGLMQRFANASKQARENGLTRLVQDMLLPWWPSYYDHVERAVRHIRVSHRPDHGFEGAMMKGTAHGIREDGIREDGRIKQRPKAKGSADHKTITLIPIDEPRQLARHGVDAEGKPLPYKGYASGSNYCIEITKNGKGKWEGQVISTFDAYRIKAAADAAARAGQVISTVEADSIVRKSGWERLRGAQSQNGQPLVMRLVIGDSVRMEVDGRDEVMRVVKMSGKEMVFAPVREANVDKRNNMPDEQDPFTYTYKRADQLRKAKARQVTISPIGELRDPGFKG

SEQ ID NO: 565 - protein, 1068 aa, Artificial Sequence
  Cas9
MQYVLGLDIGIASCGWAVINQEKERIEDLGVRIFDKAENPKDGKSLAAPRRDARSTRRTLRRKKHRMLRIKILLVKQGLLSKNELNHLYESTTEVDVWNLRLDALERKLNPKEFTRVLIHLAKRRGFKSNRKETTLSENGQILESISENQQIMEQQNYRTVGEMILKDKKFENHKRNKDGTYIGTVTRQQLQEEIQMIFTAQRLYKNDYATEEFEISYLEIWASQRPYASKDQIEKMIGYCTLEPKEKRVPKASWSFQYFVALQTINNLRLISKDRIEELSFKEKKQIMNLALEKSIVKYIDIRKLLSIPNEFQFNSLSYSADTVDTTLENKRCIELKEYYSINKVYKQIYEKNALNLLPIDYDTIAYGLTIFKDDKDILEYLQNKYVNAKGKPINNLAKKTYDYTFIQALLTLNFTKMGHLSFKALKNIIPFLEEGLSYDKACEKAGYNFKGTSYTEKTKYLPVIPQNTNPVVHRALSQTRKVINAIIKKYGSPNAIHIETARELSKTFQERKEIDSMYQDNSKKNEHAIHKLKELGNINPSGINIVKFKLWNEQDGRCMYSGKYIEPHRLFEEGYTEVDHILPYSRSLDDSYNNKTLTLGTENQRKGNKTPYEYMGNTSIWNDFETRVHSNKKINKKKQQKLLLQHFSYAREQEFIERNLNDTRYATIYLSSLIQQHLIFSESSRKKKVHTVSGIITSHLRSRWGFNKDRKEGHIHHALDAVIVAVTSDHMIQRVTKYYKLKELNRNLQAKRMPFPEPWEGFRLELEARISPNTQQYLKGFRFKNYADVNLSEIKPIFVSRMPKRSITGELHQETIRKFIGYNEKGKVLTAIKTKLEDIPFDANGDFPMYGKETDLYTYNAIKERFLSHKKDKRKSFQEPLYKPTKSGGIGPLIKSIKIIDTRTIVNPVNQGKGVVYNSKIARTDVFKKDEKYYLIPIYTIDLMKNILPQKAITAGKGYEDWTTIDPSFTFLFSLFPNDLIQIVPSKNKTIKARTTVSKKEVLLPSLTGYFKGVHSGTAGITVETHDGSVIANVGSKQLLLIEKYQVDILGHYTKIKEEKRIGMAI

SEQ ID NO: 566 - protein, 1068 aa, Artificial Sequence
  Cas9
MPKSAKPQQAYTLGLDIGIASVGAALLGQQHIIGLHVRTFDRAETAKEGEPLNKIRRDARLTRRRLQRRAHRLLRLRRLFKRHNLIPDTDTSTFISGQSPWELRAQGLDRQLTSAEWTTVLYHIVKHRGFHSNRKSEVKTDEKAGQMLSGVNQNQALLKQSGLRTMGELAARHEAFREAKRNKKGAYNHTFSRHDLEDELHLLFSRQRELGNPYATPELEDAVHTLLMQRRPALSGTNLLKMVGHCTLEPDEFRAPKASYTAERFIWLTKLNNLRVSGSGETRPLNESERQALLSKPFSQSKLTYKQVRKILELPDNIRFVGLHYHPAQDNGKSPENRVFFEAKAFHALRNVYKKAGLNLEWQRDSQNPEKLDNITYALTVFKEDKEAKQWLIEKGVEASVIEAVLNESFSEFVRLSIKALRKIIPHMEIGHRYDEAVKLAGYSHHSHLPQPSKTPYIPRFSKQSIANPVVSRALNQARKLVNAIVREYGPPDAVHIELARDLNKPFDERRKIEKDQEKYQKDKARDIETFQENFGFTPKGLQLTKWRLYREQSGKCAYSLKPLDINRLFEDGYVEIDHALPYSRSFNDGMNNKVLTLTTENRNKGNQTPYEYLDGASNSAQWRNFVAWVNSNKSYRASKQRNLLRKDFAAQAATEFRERHLTDTRYIAREFKRMVETHLKLNKPNQRCVVVSGQLTAYLRARWGLIKVRENGDLHHALDAAVVAACSHAMVKRLADYSRRGELQYARGHHFDPETGEIIDINALRKLDDHFPQPWTDFRRELLAWLSPDPAQQLKNLAYYTDERLKQVKPIRVSRAPTRRGLGAAHQETIRSAKYLGENRSTVKTPLEKLKLKDIPNIVGYEDPRNHQLIQAISQRLTEHGDDGKKAFKEPLYKPGNNKSTAPVVRSVKLFTVQKSGIPVRGGIANNGNMVRVDIFTKKERYFAVPVYVSDAARNELPNKAVARGKDGWIDIDDSFSFLFSLYPNDWVSVVVKPHEAPCEGYYAGLDISTGAIHIWAHDRNRSVGKNGLMRSIGIKTAHSVEKYHVDLLGNLYRVVHETRKPLRAGK

SEQ ID NO: 567 - protein, 1068 aa, Artificial Sequence
  Cas9
MQYVLGLDIGIASCGWAVINQEKERIEDLGVRIFDKAENPKDGKSMATPRRDARSTRRTLRRKKHRMQRIKIILVKQGLLSKTELDHLYESATEVDVWNLRLDALERKLNPKEFTRVLIHLAKRRGFKSNRKETTLSENGQILESISENQQIMGQKNYRTVGEMILQDKKFESHKRNKDGTYIGTVTRQQLQDEIQMIFNAQRLYKNNYATAEFENSYLEIWASQRPYASKDQIEKMIGYCTLEQKEKRAPKASWSFQYFVALQTINNLRLISKDRIEELSFEEKKQIMNLALEKSIVKYIDIRKLLSVPNEFQFNSLSYSADTVDITVESRKCIELKEYHSINKVYKQIYEKNALNLLPKDYDTIAYGLTIFKDDKDILEYLQNKYVNAKGKPISNFANKTYDDTFIQALLNLNFTKMGHLSFKALKNIIPFLEEGLSYDKACEKAGYNFKGTSYTEKTKYLPVIPQNTNPVVHRALSQTRKVINAIIKKYGSPNAIHIETARELSKTFQERKEIDSMYQDNSKKNEHAICKLKELGNINPSGINIVKFKLWNEQDGRCMYSGKYIEPHRLFEEGYTEVDHILPYSRSLDDSYNNKTLTLGTENQRKGNKTPYEYMGNTSIWNDFETRVQSNKKITKKKQQKLLLQHFSYAREQEFIERNLNDTRYATIYLSSLIQQHLIFSESSRKKKVHTVSGIITSHLRSRWGFNKDRKEGHIHHALDAVIVAVTSDHMIQRVTKYYKLKELNRNLQAKRMPFPEPWEGFRLELEARISPNTQQYLKGFRFKNYADVNLSEIKPIFVSRMPKRSITGELHQETIRKFIGYNEKGKVLTAIKTKLEDIPFDANGDFPMYGKETDLYTYNAIKERFLSHKKDKRKSFQEPLYKPTKSGGIGPLIKSIKIIDTRTIVNPVNQGKGVVYNSKIARTDVFKKDEKYYLIPIYTIDLMKNILPQKAITAGKGYEDWTTIDPSFTFLFSLFPNDLIQIVPSKNKTIKARTTVSKKEVLLPSLTGYFKGVHSGTAGITVETHDGSVIANVGSKQLLLFEKYQVDVLGHYTKIKEEKRIGMAI

SEQ ID NO: 568 - protein, 1069 aa, Artificial Sequence
  Cas9
MKKQPQRYILGLDLGIASVGWALILVDGAENPVGLLDCGVRTFERAEVPKTGDSLALARRQARSVRRLIRRRAHRLLRLRRLLKREGILSAADFNSDGLPNLPIDAWQLRVAGLERKLTNQEWAAVLLHLVKHRGYLSQRKSETQTENKELGRLLAGVAENSKLLSESSEQYRTPAELAVKLFAEQSGRLRNKGGDYTHTFNRLDLQKELHLLFERQCALGNPFASAELQSKVDELLMTQRSALQGEAVLKMLGKCTFEPSEYKAAKNTYSAERFIWLTKLNNLRILYNGEDRALDEGERKQLLDEPYKKAKLTYKQVRSILNLPESAVFKGLRYGKDSDGLKAENGALMEMKAYHKIRTVLEKAGLKGEWENRIRNPEILDQIGTAFSVYKTDEDIKAELAALRLPENVLDALLAGLNFDKFIQLSLKALSNILPLMERGIRYDEACKEVYGDHRALAESKNQMLLPQIPANEIRNPVVLRTLTQARKVINAIIRRYGSPQRVHIETARELGKSFKDRKEIEKRQEENRKERERAAEHFKELFPRFTGEPKSGDILKLRLYQQQQGKCLYSGIPIDLGRLNEKGYVEIDHALPFSRTWDDSFNNKVLVLGSENQKKRNQTPYEYLDGARDSQRWREFQARVQGCRFPYAKKQRIQTAKLDSKTEQGFLERNLNDTRYIARFLCGFIEKSLHLQGAGKRRVFASNGQITALLRGLWGLKKVREDNDRHHALDAIVVACSTVSMQQKITKAMQRRETLETINTETGEVKTRIPQPWDFFRQEVMIRVFSDAPREELAEKLNSRPEALHDFVSPLFVSRAPNRKMTGQGHLETVKSAKRLSENISVVKKPLTALKLKDIENIVGYPDREPALYRALQERLQAYKDDPAKAFAEPFYKPAKDGGQGSLVKAVRIIENTKHGLKVRNGITDTNGDMVRADVYQKADKKGKRQYFIVPVYAWQVEKNELPTVDCKGYEIDDTYEFCFSLYKYDIIEIQNPDNMSKELRVYYINCDSSDGRFWLAHHDKSAKEQQFRISTQNQPIIKKYQVDPLGKEIRLCKAEKRTELNGKKKK

SEQ ID NO: 569 - protein, 1069 aa, Artificial Sequence
  Cas9
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLRVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 570 - protein, 1069 aa, Artificial Sequence
  Cas9
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLQVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 571 - protein, 1070 aa, Artificial Sequence
  Cas9
MATRLGLDIGTNSIGWCLYDGDSIRDIGVRIFLDGREPSKLTVSGSGTPLAVKRRDARGARRRRDRYIGRRSAMLRELRKHGLLPADPKQAKVLETQDPYALRVRALDEKLEPHQIGRALFHLNQRRGFKSNRKAERASKAGEDGKIATATKLLDEEMQRLGARTLGEFLVKRDSEFDGEAGKRVRMRADSKAYDFYPDRRHVLDEFRAIWNAQKVWHPELLTEQAWNDIFRVIEYQRELKPQVVGHCTFAGINGVPADEKRLPKAHPLFQQRRLYEEVNQLKVVAPGEAGRPLTRDERDALILKLQDKKSVSFETLGKTLKLKDGERFNKESENRKALDGDEVRAALSGKKLFGTRWFHFSAEEQWMIIERLLEEEDSETLLTWLKIGYRLDDEAALAVANAKLPEGHGRFGLSATTALLKELKADVCTYAEAAKRAGFHHSDFRTGEVFDQLPYYGEILAREIAPGKPEYGDENERRFGKITNPTVHIGLNQLTKLVNAIIRLHGKPDYIFVELARELKLNEKEKIAYNRQLKENTDAARDRGAKLGTMGVRDTGRNRLILRLWTELNPGDALNRRCPFCGEQISQRMIQNGEVEIEHIIPYSQCFDDGIGNKVLSHVRCNRQKGDQTPWERWGHDPDRWSIIQEQVAHLHRSKQWRFGPDARDRYAAEEDSFLPRQLIDTQYLTRIAAKYLACLYPERGERHVFAVHGGMTAMLRRLWDLNSILLDHNWVENLNSNAPKNRLDHRHHAIDAAVVGIMTPGLIAEIAKAAARAEKQNLDRLFEELPMPWAQHPNDRRFRDELREKILAATVSHKADHGRQGKPERGRDITAGKLHNDTAYGFTGLTSDTGLPVVVHRVPLTSLTPKDIADPDRIPDTTLRGSLWQATRDLSGKEFEKALLDFSRTHAQFKGIRRVRVREGLTLIPIRNHAGKPYKGYLGDSNARYNVWQMPDGRWVHQVISTFDLHQPGFIEQRPHPAAKKVLSLRQNDLIAIERDGALRQIMRVQKYGQNGQIFLIEHNEAGNMAERNKNTDDPFKFYGPGASALRNMKARQVRIDELGRIFDPGPR

SEQ ID NO: 572 - protein, 1070 aa, Artificial Sequence
  Cas9
MAKDFEYILGLDLGETSIGWSVVRLNEGVPEHLERLGVRICSDGRDAQSHEPLSVARRIARGLRRRRDRYIHRRIRLTDVLVKYGLMPEDIKERKKLQALNPYRLRSEALDRKLEPYELGRVLFHINQRRGFKSNMKTDRKDSESGAMKQAILKTRAKMEASGARTLGEFLYFLNKDKTSTQEYVPVRMRSHSEKNKTVYEMYPDRAMYEDEVHKIFEQQELSPEAQTEIFNTIFFQRPLKPVELGFCEFEDGERRAYTASVVFQKFRALQQINQIYVQDDYERRPLTKEEKDILKHFLLEDFSALDKNGLLTWAKVRTLLKLQKKKFNLESERRKGLNADVTSWKLSNAACFGREWFSFSDAKKEEIVALITGAEKEEELIAELKTKYGLSDERAKNTANVSLPDGVASLSAKAMKKLIPFLEEGMLYDDAVKQAGYVFSSSFKGVLPEKYETFIEPESGECFDELPYYGQVLRRYVLGGVPSEENKLFPEKYYGKINNPTVHIVLNQLRKLINSLVAKYGHPRKIVVEMARDLKLSKKQKDAIAKEQALNERENKRIGAELERLDIRNNYDNRMKYKLWEDLSTDPTKRSCPFCGKQISQQDIFSPEFEIEHLIPFSRSFMDGRSNKVLSCRRCNREKGNKTPFEAFGNDSTRWNAIMGRVESLPENKRWKFASDAMSRFERDGDLLARMMTDTQYMARIARRYLCCAANPNQVYGIPGQLTAKLREHWGLNSILSDQKEKDRSDHRHHAIDAFVVACTDRGTLQKYSTERRDYAKPEMPSEKAPHIPFADFRLSDIKRVFDEIIVSHKPDRGNARAAILKGGTVAKLHEETYYGMGGEGSKKGTWKLIQRIPVSEIKKASDLDCLIDQKGTANPLRVLLVGASESEQEQIIASYFARRGTHKVRTYRERNKDVILPFKDKDGKLYRYAVYGSNAYAEIYCPDRGKNAGKWQVEIIPNYCAHQKGFIPKWRHTDAHAKLIMRLYRNDMVAYEKEGKTVIARVKKMGGNGVIVFRNHLIAKEEGDRLSWQAVVSGMQSANLRKIYVDVLGRVIDPKRPMTQNETDGQDN

SEQ ID NO: 573 - protein, 1070 aa, Artificial Sequence
  Cas9
MSHFRLKQLNYILGLDLGIASVGWAVVEIDTEENPTRLIDVGVRTFERAEVPKTGDSLAAARRQARSARRLIRRRTHRLLRARRLLKREGILHADDLNAEGLVKELPNTPWQLRVDGLDRKLMPKEWAAVLLHLVKHRGYLSQRKNESEGADKELGRLLAGVHENHQALQSSEYRTPAELAVKKFQAQSGHIRNQRGDYTHTFDRKDLQQELHQLFAAQQKYGNPFVSDGLKQGIETLLMQQRPALSGDAVQKMLGRCTFETEEFKAAKHTYSAERFIWLTKLNNLRIQENGNERCLTAQERGQIIDLPYKKAKLTYAQVRKELSLPENAFFKGLRYGKENAETAALMEMKAYHAIRKALEKAGLKTEWQGLACKPELLDAIGTVFSLYKTDEDISTRLQGQLSEDVINALLAGLNFDKFIQLSLKALSKILPLMEQGQRYDEAHAALYVRSTPQPQRLLPQITADEICNPVVLRTLSQARKVINAIVRRYGSPARIHIETGREVGKSFKDRQEIQKRQEDNHKERKQAAEKFLEYFPNFVGQPKAKDILKLRLYQHQHGQCLYSGKTLDICRLNEKGYAEIDHALPFSRTWDDSFNNKVLVLAGENQNKGNQTPYEWLGGASNSPRWQEFVARVGSSRFHHSKKQRILLRQLDEEGFKERNLNDTRYVARFLCKFIEENMLLLGRGKRRVFASNGQITSFLRSRWGLRKVREENDRHHALDAVVVACSTVAIQQRITYFVRQREMNIFDGELIDKETSEVSRPYFPQPWDFFRQEVMMRVFGKPDGDPSFPEADTKETLCTLLETRLSSRPQAVHEYVTPLFVSRAPTRKMSGQGHKETVKSAKLLHEGKSVLRVPLTQLKPNLLEKMVNRDREPQLYEALKERLAAYGNDPAKAFATEFRKKGGQLVKAVRVEDTQKSGVLLHKGTGVADNATMVRVDVFEKSGKYYLVPIYSWQVAQGILPNKAVIQGKDEKNWDEMDETYTFKFSMYPNDLVEINTGKQRLFGYYIGLDRATGAISIREHDLDNFKGKNGIYRVGVKTAISFKKYQTDELGKVVVPCRPKKRLPVR

SEQ ID NO: 574 - protein, 1071 aa, Artificial Sequence
  Cas9
MRLGLDIGTNSIGWWLYQTDDGTITDVLDGGVRIFSDGRDPQSKESLAVDRRVARAQRRRRDRYLRRKAALMKRMAGAGLMPTDQAHAKKLESLDPYALRAEGLDCELPLTHLGRALFHLNQRRGFKSNRKTDRGDNESGKIKDATARLDWAMRDAKARTYGEFLHTRQQKADDPKRMPTVRTRLTVARRDNAEKEEAGYDFYPDRRHLSEEFDALWAAQADYHEALSDDLRDQIKTIIFHQRPLKTPEVGLCLFTDERRIPSAHPLNQRRILLETVNALRIVARGEAARRLTLEERDQIVHALDNKNHTKTLSGMAMKLKALGKVIRLRSDQTFTLETANRDAIACDLVRASLSHPDRMGGVWTTLDEGAQWEVVQRIRAVQSDSEFDALVVWLEQNHGLDNAHAQATANAPLPEGYGRMGLMATRRILAALQSDVMPYSDAVAACGWSHSGGPTGEVLEKLPYYGKILDRHVIPGTYDENNEDVKRYGRITNPTVHIGLNQIRRLVNRIICIHGKPDEIVVELARDLKNSEDQKREIQKIIKKNTDAAIKRGEKLINELGQKDTGANRLVLRLWEDLGHDVMTRNCPYSGKRISAGMLFDGSCDVDHILPYSRTLDDGIANKTLCLKEANRQKSNNTPWEVWGETEQWDTIAANLKNLPDNKAWRFASDAMQRFEGENDFSARALKDTQYLSRIARAYLDALYDGGDGNSHVWVVPGRLTEMLRRHWGLNGLEALTDSDENTVKAKNRMDHRHHAIDAAVVAATDRGLIQRISKIAKRDEQAGAEEVARSVSPPWDGFRDDIAAQLSRIIVSHRADHGRIDSQAKQQGEDATAGQLHMDTAYGVVDAGRVVSRKPLLSLSESDIKKIRDPDLQRHLTRVTKGLDKKEFEHALSDFANARKLPDQSENPYFGMRRVRLIDALQDSARVSVRDRDGHIYKAYKAGSNHCYEVWRLPDGKIKPWAISTFEAHQTGTESKPHPAAKRLLRVFKRDMVAIERDGETLMCYVQKMDIANGLFLVPHTEGNADARNRDKDDSFKFIQMSAVSLIRAKIRRIHVDEMGRLRDQGPPR

SEQ ID NO: 575 - protein, 1071 aa, Artificial Sequence
  Cas9
MRYTIGLDIGIASVGWAVINEDKSRIEDLGVRVFKKAEEPDGKSLNLARREARGSRRRIRRRATRMQKVKELLVKYNLVSEKELETLYIITETTPDVYELRAKGLDRLLSRQEFARVLTNIAKRRGYKSNRKIDEEDKEVGKLSKGTIENKRILQEKGYRTIGEMFYKDEKFEYNKRNKAGEYNSTVLRSMLIDEVHTLFEMQRKFKSEFANEEFEKEYVEVMTYQKPYITPELLEKMLGKCTFEKGEPRAPKNSYTFERFMLLQKVNNLNIYINGEKVEIPQEKKKEIIELAYKQSEIKYTQLRKKLELPIEARFADLNYQIKRTEDESEEALVKKIEDKKFVKLEGWHKIRLALKENKDKFEKIEKNPELQNIIADALVRNKTDETIKNYLEKSDIDEEIINAILNINFTKFGHLSYKAMNKIIPELEKGLTYDKACENVGYEFKGRKNELQYKLPPVTELEDEILNSVVLRAVSQTRKVINAIIDKYGSPTAIYIETARELSKPYDERMKIEKRQKENAANNDQIKEYIKETFGFDPKPFDIVKMKLWREQNGKCAYSSKPIPAERLYEENFVQVDHIIPFSRCFDDSYQNKVLVLTDENQKKKERTPFEYFGEDKERWHQFEEFVNLTYKFNTRKKENLLIKNFNEEKSKEWIQRNINDTKYISKFMYNYIANNLKFADSESKRKVYNINGQATSILRHYWGLKKDREESDKHHAQDAVIIACATNKNIKKVSDYSRRKLLYKNNEIIDEETGEIIDKKYNIDISIKEPWPKFREEVEARMEDADNNGQLYALINGNFTNYDDVDITHIKPIFTSRMPERKITGRAHKDTMRSQKFIQQGQNFTVVKKPLKAISKQEIEGIINNPDFKNLYLSDKKLYDDIYQKMKEADFKAEKAFANEYRKYSKNGNSPIVRSIKVASAGATGVQLKNGAIAENANMVRVDVFEKDNKNYLVPIYVSDFAKNELPNKAICANKDEKEWIEMTEKYKFKFSLYPNDLVKIKRKNEKEFYAYYCSTHRGTGNINLLLVNGEARKDGVGIKNTEIFEKYQVDVLGNISKVNKEKREGVK

SEQ ID NO: 576 - protein, 1071 aa, Artificial Sequence
  Cas9
MDYRIGLDIGTNSIGWSIIELTTVQSKLDGKYRLKAVGLIDAGVRMFDRAEVPKTGASLALPRRLARSSRRRLTRRSARKKAIRNLLVKEDILNQIELDHLYRTSELVDIWQIRVEGLERRLGRQEWARLLIHLGQKRGYRSTRKAEEGADTEGRAVLSSIKENQETLKQYRTVGEMWATDDKFKGRVRNSTNEFIFNVSRDNLEEEIRFLFQQQRELGSMYASKLLEESYMEVWGHQLPFASGESILKNVGTCSLYEKEKRAAKATYTFQYFMALDKLNNVRILPSMRTLSEEERGLALKAMFERDKLPKNPPKFTYSHLRKAIKLEEDETFQTISYDVEKTLATNESAVFVNLAAYYQIKKVCDEHNENYDYVDYNTIGHALTVYKTDEDINKYLASKNNIAKRVYANDFIDSVLKHSYTTFGHLSLKALSRIIPLMEEGEVFAKAKEKAGFKEESYLEIKSKLLTNIPDAIKNPVVMRSLTQARKVINAIIKRMGEQPASIQIELARELSKDVSERKKITNGFAENRSRNQFAIKTLEENHITNIRGQDIVKFKLWQEQGGRCAYSLKPIKLEELISFLKKERRYEHNLDVDHIIPYSKTFDDSYTNKVLVFSDENRKKGDQIPAEYLGIGTKRWEKYKEFVITSKFPASKKKRLLKEQLVEREELFMKERHLNDTRYASRYFMNFLRENLLRKETVLHETQWVTAVAGRVTSHIRKRLGFGKDREETHLHHALDAIIVACTDKWMIDCVTNYYKSREGGSIKRKEIRFPSPWNGFWHDVQTKLAQLPQPEVINESISKGNPDAVDYMLVSRMPRKSITGAAHKETISKWGGYDDKGKALLVKKVALSELKFKNDDFPMYNKETDPLLYEAIKNRYVESGRDVKRAFATPLYKPSKSGKRNEVKRVKVIAEKKAMVREVNGGIAENGGLVRSDIFLKEKKYVMVPVYTFDTIKQQLPNKYVVSGRGYEQWPELTAEHVFQFSVYPYELVHVGTNKGDNSFYYFASLNISSNVLKFSECNRPTKDYIEIGLNSIILLEKYEIDVLGRITGQSKKGIRQSFKNNKSQMKE

SEQ ID NO: 577 - protein, 1072 aa, Artificial Sequence
  Cas9
MRLGLDIGTNSVGWWLYKTDGEAASARIVEVIDGGVRIFSDGRDPKSKTSLAVDRRVARAARRRRDRYLRRRASLMKLLARTGLMPADPVEAKKLERLDPYELRSTGLDDALPLTHFGRALFHLNQRRGFKSNRKTDRGDNENGKIREATARLDLEMMTSGARSYGEFLHMRRQRASDPRHVPSVRTRLSVAARGGPDAKAEAGYDFYPDRHHLEEEFHALWAAQATHHQALTDDLRDLVFEKIFYQRPLKEPKIGLCLFTAEERIAKAHPLTQRRVLFETINQLRVTADGRSTRPLTLEERDTLVHALDNKKPTKSMTSMNMTLKALAKLLKLRDGERFTLETGVRENISCDPVRACMAHPARFGPQWSSLDWEAQWDVISRVRQVQSEGEFIELTDWLIQGHGLDADHAKAVGNAPLPEGYARLGFSATERILDQLKAEVCTYSDAVAKCGWHHSDQRTGACLEVLPYYGEVLDRHVIPGTYDATDDEITRYGRITNPTVHIGLNQLRRLVNKIIEVHGKPDQIVVELARELKQSEPQKKDAMKRLRNTTADAIRRSEQLEQLGQPNTGHNRMLLRLWEDLGPAIGPRCCPYTGKTISVTMVFDGSCDVDHILPFSRTLDDSFANRTLCLKEANREKSDRTPWEAWGGTDQWDDIAANLKNLPEKKRKRFGPDAMEWFEGENDFLDRALVDTQYLAKISRMYLDTLFTKGGHVWVVPGRMTEMLRRHWGLNALLNDKDRGAVKAKNRTDHRHHAIDAAVVAATDYRLMQKISRAAGQGENAGQSAELIARDTDAPWEHFRADIASQLEKIIVSHRADHGRIDVEGRKTGRDSTAGRLHNDTAYGVIDDLTVASRTPLMSLKPSDIAITERGKNIRDPQLQNALYVATKGKEGKMFEQALVDFASKEGPYQGIRRVRLVETLQKAARVEIGKTESGQPLKAYKGDSNHCYELWKLPDGKIVPQVVTTYEAHAGSAPRPHPAAKRILRVFKKDMVKLTKDGEEIVGYVQSMHIKNGLFVAQHLEANADARNRDKTDPFKFLQMGAGTLVKTGLRRVLVDEIGRLRDPGPPKL

SEQ ID NO: 578 - protein, 1074 aa, Artificial Sequence
  Cas9
MQTKNLPYTLGLDIGMASVGAALLLPDQERILALHVRTFDKAETAKEGESLNKIRRDSRLTRRRIRRRAHRLVRLARLMKRVGLIADANPEAFALPGVSPWHLRADGLDRLLEPKEWAGVLYHLVKHRGFQSNRKSEAKADEKAGQMLSGVGRNQALLKEAGYRTVGELAARHEDFKEAKRNKGGSYSHTFARADLNAELNLLFERQRALGSRLASADFQENVRDLLMARRPTLSGANLLKMVGKCTFEKSEDRAPKAGYRAERFVWLGKLNNLKIVGSGDARPLTDAEHRIVIDLPFTQAKLTFKQVRKALELETHQRFNLLSYRPDPKGKDKDPEESTFFEAKSFHTLRKAYEGAGLKKEWQRDALDPDRLDALAYALTCYKDDTESRQWLVAQGIGTPIIEAVLAESFDKFIHLSQKALKAILPHMEAGQRYDDAAKSAGYDHSQPDAGTGKRATLPPPDKDTIRNPVVYRALNQARKLVNAIVAEYGPPAAVHIELARDLSKPIDERRDIEKGQKEFQALKEKLAAAFEETFHRKPSGLDLLKYRLFREQLDQCPYCQKALVVDRLFEPGYAQIDHALPYSRSFDDGMNNKVVVHVACNQDKGNRTPYEFLDGAGDSERWQRFVAWVQGNKAIRQAKRNRLLRVNFGTDEAKEFSKRNLSDTRYICREFKRTIETQFAWHSDAEGNERCVVLSGQLTSLLRARWGLIKVREDGDLHHALDVAVIAAASRSLVKRMADYSRRNELEMVRNRYVDPATGEVVDVAALRQIEDHFPKPWPLFREELLARLAPEPKLQLTCVSSYDEGLRESIRPIRVSRAPTRRGLGAAHQETIRSLRDGSQSAIKTPLRDLNLKDLENIVGFERDTALIDAIRTRLEAFGGEGKKAFDDKQPPLRKPSKDPDKAPIIRSVKLLVTQKSGIPIRGGIANNGAMLRSDIFTKAGKFYAVPIYVADAVRGELPHRAVAQAKPELEWPMMDESYQFLFSLHPNDWMTIRLKNEVREGYYAGLDRATGNISLWLHDRNQNVGQKGLLTGNGIKTALAVEKYHVDLLGKLHRVHKEERQPIHIKPGKR

SEQ ID NO: 579 - protein, 1077 aa, Artificial Sequence
  Cas9
MKYSIGLDIGIASVGWAVINEDIERIEDLGVRIFDVAEQPKTGASLSTPRRLARSTRKRLRRRRHRVERVRKFMIQKGLLTQVQMEQLYDWKDGDLDIWLVRVNALERKLSDREFARILVHFAKNRGFQSNRKSELQEEDNGAVLSAVQENKRLMEEKGYQTISEMLLYDEKFEGTKRNKGGEYTHVVARSDLKREIQLIFEKQRAYGHAFATMENEDKFLQIWSSQRPFATKDDIAKKIGNCTFEPKEKRAPKSTYTFERFRALDKLNRLRILSGTSPARSLTQEERDLILNSLFSKKEVKYKELRKLLKLNDEQRFNEIFYDPNEKIEKNENRTFLSLESQYKIRKILQKIEGKSLNDTYRPVDLDTIAYALTVFKDDQDIRDYLQNQYVASNGKKELNLANRKYNDELIEELLHLSFTKFGHLSLKALRNILPFMEQGIPYHQACEKAGYQFNKKVNREKQKLLPPVPAKDIVNPVVIRSLSQVRKVINGIIKRYGSPSSIYIELAREMGRGYKERKDLEKQYNKNRQMNEGAKKHILELRPEFGDPRGHDILKYKLWQEQDCRCAYSFKSIPIKQLFEIGYAEVDHIIPYSRSFDDSNNNKVLVLAAENQNKQNRTPYEWFGHDETKWQEFTSLVTTMKVSKKKKSLLLKKNFDEEQAEEFRSRHLNDTRYITRYIKTFIEDNLQFRIEEGKKTYVHTVNGAYTSLMRKRWGFNKNRQENALHHALDAVIVAVSLPFKHKVRAYFKRREEYAHNQLKREGEFFPEPWPGFIHELEIRMMQDSENIKLAMESLNLKTYDESFIKELKPIFVSRMPKRAMKGQIHEETLKRVRGRTDDGYIRTVKKVKLDQIPFDKNGDFPMFGKETDMKTYEAIKSRYLESGKDKKKAFNTPLYKPAKNPENAPIIRSIKIEEKANRVVMLDEKTAADNASIVRTEVFRHKETGNYFLTPVYVADVLAKKVPDRLITTKKPYSEWRKITDEYEFLFSLYPNDLIRVKMPKEKETKTHTGEKHVWQENFMYFKGVHSGSAGVRMIDHMNSFEDEIGVRKLVVFEKYQVDPLGRMNKVHGEKRHGI

SEQ ID NO: 580 - protein, 1077 aa, Artificial Sequence
  Cas9
MKYSIGLDIGIASVGWAVINEDIERIEDLGVRIFDVAEQPKTGASLSTPRRLARSTRKRLRRRRHRVERVRKFMIQKGLLTQVQMEQLYDWKDGDLDIWLVRVNALERKLSDREFARILVHFAKNRGFQSNRKSELQEEDNGAVLSAVQENKRLMEEKGYQTISEMLLYDEKFEGTKRNKGGEYTHVVARSDLKREIQLIFEKQRAYGHAFATMENEDKFLQIWSSQRPFATKDDIAKKIGNCTFEPKEKRAPKSTYTFERFRALDKLNRLRILSGTSPARSLTQEERDLILNSLFSKKEVKYKELRKLLKLNDEQRFNEIFYDPNEKIEKNENRTFLSLESQYKIRKILQKIEGKSLNDTYRPVDLDTIAYALTVFKDDQDIRDYLQNQYVASNGKKELNLANRKYNDELIEELLHLSFTKFGHLSLKALRNILPFMEQGIPYHQACEKAGYQFNKKVNREKQKLLPPVPAKDIVNPVVIRSLSQVRKVINGIIKRYGSPSSIYIELAREMGRGYKERKDLEKQYNKNRQMNEGAKKHILELRPEFGDPRGHDILKYKLWQEQDCRCAYSFKSIPIKQLFEIGYAEVDHIIPYSRSFDDSNNNKVLVLAAENQNKQNRTPYEWFGHDETKWQEFTSLVTTMKVSKKKKSLLLKKNFDEEQAEEFRSRHLNDTRYITRYIKTFIEDNLQFRMEEGKKQYVHTVNGAYTSLMRKRWGFNKNRQENDLHHALDAVIVAVSLPFKHKVSAYFKRREEYAHNQLKREGEFFPEPWPGFIHELEIRMMQDSENIKLAMESLNLKTYDESFIKELKPIFVSRMPKRAMRGQIHEETLKRVRGRTDDGYIRTVKKVKLDQIPFDKNGDFPMFGKETDMKTYEAIKSRYLESGKDKKKAFNTPLYKPAKNPENAPIIRSIKIEEKANRVVMLDEKTAADNASIVRTEVFRHKETGNYFLTPVYVADVLAKKVPDRLITTKKPYSEWRKITDEYEFLFSLYPNDLIRVKMPKEKGTKTHTGEKHVWQENFMYFKGVHSGSAGVRMIDHMNSFEDEIGVRKLVVFEKYQVDPLGRMNKVHGEKRHGI

SEQ ID NO: 581 - protein, 1077 aa, Artificial Sequence
  Cas9
MQQKPQRYILGLDLGIASVGWACVWADENEHPTGLLDCGVRTFERAEVPKTGDSLALARRQARSVRRLIRRRAHRLLRLRRLLKREGVLLSADFNENGLVRGLPIDAWALRVAGLDRKLSNKEWAAVLLHLVKHRGYLSQRKNETQSKDKELGRLLAGVNGNREALQNRSDEYRTAAELAVKKFAAENNGSLRNKGGDYSHTFDRKDLQRELHLLFERQRALDNPFTSSEMEAAVDELLMKQRSALQGEAVLKMLGRCTFEPSEYKAAKNTYSAERFVWLTKLNNLRIQYNGEERALSEAERRLLLDEPYQKAKLTYKQVRTILELPESAVFKGLRYGHGEDGLKAESGTLMEMKAYHAVRKALKDAGLEGEWENRIRNPELLDAIGTAFSLYKTDEDIRANLAAFRLSENVLEALLAGLNFDKFVHLSLKALAKILPLMEQGMRYDEACKEAYGDHYGAKEQEDHRLLPPFVADDIRNPVVFRTLTQARKIVNEIVRRYGSPLRVHIETGREVGKSFSDRKEIEKRQEENRKERERAAAHFKELFPNFAGEPKAQDILKLRLYEQQHGKCLYSGKEIDLRRLPEKGYVEIDHALPFSRTWDDSFNNKVLVLGKENQDKRNRTPYEYLDGKGNSGAWRAFAERVSGCRFPYAKKQRLLTQKLDEKTEQGFLERNLNDTRYVARFLCQFIEEKMHLEGAGKKRVFASNGQITALLRGFWGLKKVREENDRHHALDAVVVACSSVSMQQKITRHFRYREELEHIDRETGEVIHGFPQPWEFFRQEVMTRVFSDDPVSELAEKLDSRPEAVHEFVTPLFVSRAPHRKVTGQGHLETIRSAKRLDEKISVVKLPLTQLKTKDIERIVGYPNREPALYDALAARLAAFKDDPAKAFSEPFYKTGKDGKCGVLVKAVRVENVQKSGLLVRKDESGKMQGVADNATMVRVDVFGKNGKNYLVPVYAWQVEKGELPNRAVVAYADEEDWDEMDDSFEFKFSLYPNDLVEVVTKKDKFFGYYSGFNRATGAINIKEHDLSKSKVKNGVYEGIGVKTAQSFQKYQVDTLGKTIRLCKPEKRMGFKKK

SEQ ID NO: 582 - protein, 1078 aa, Artificial Sequence
  Cas9
MRYVLGLDIGIASCGWAVINQEKERIEDLGVRIFDKAENPKDGKSLAAPRRDARSTRRTLRRKKHRMQRIKVLLVKHGLLSKTELDHLYESATEVDVWNLRLDALERKLYPKEFARILIHLAKRRGFKSNRKETTLSENGQILESISENQQIMEKQNYRTVGEMILKDKKFENHKRNKNGTYVGTVTRQQLQDEIQMIFHAQRLYKNDYATEEFESSYLEIWASQRPYASKDQIEKMIGYCTLEPKEKRAPKASWSFQYFVALQTINNLRLISKDRIEELSFEEKKQIMNLALEKSIVKYIDIRKLLSVPNEFQFNSLSYSADTVDTAVESRKCIELKEYHSINKVYKQIYGENALNLLPKYYDTIAYGLTIFKDDKDILEYLQNKYVNAKGKPISNFANKTYDDTFIQALLNLNFTKMGHLSFKALKNIIPFLEEGLSYDKACEKAGYNFKGTSYTEQTKYLPVIPQNTNPVVHRALSQTRKVINAIIKKYGSPNAIHIETARELSKTFQERKEIDSMYQDNSKKNEHAIHKLKELGNINPSGINIVKFKLWNEQDGRCMYSGKYIEPHRLFEEGYTEVDHILPYSRSLDDSYNNKTLTLGTENQRKGNKIPYEYMGNTSIWNDFETRVQSNKKINKKKQQKLLLQHFSYAREQEFIERNLNDTRYATIYLSSLIQQHLIFSESSRKKKVHTVSGIITSHLRSRWGFNKDRKEGHIHHALDAVIVAVTSDHMIQRVTKYYKLKELNRNLQAKRMPFPEPWEGFRLELEARISPNTQQYLKGLRFKNYADVNLSEIKSIFVSRMPKHSITGELHQETIRKFIGYNEKGKVLTAIKTKLEDIPFDANGDFPMYGKESDLYTYNAIKERYLSHKKDKRKSFQEPLYKPTKSGGIGPLIKSIKIMDTRTIVNPVNQGKGVVYNSKIARTDVFKKEEKYYLIPIYTIDLMKNILPQKAITAGKGYEDWTTIDPSFTFLFSLFPNDLIQIVPSKNKTIKARTTVSKKEVLLPSLTGYFKGVHSGTAGITVETHDGSVIANVGSKQLLLIEKYQVDVLGNYTKIKEEKRIGLTTYNDNKKIAAC

SEQ ID NO: 583 - protein, 1078 aa, Artificial Sequence
  Cas9
MKQQPQRYILGLDLGIASVGWALILVDEEGNPIGLLDCGVRTFERAEVPKTGDSLALARRQARSVRRLIRRRAHRLLRLRRLLKREGVLSAADFNSDGLPNLPIDTWQLRVAGLERKLTNQEWAAVLLHLVKHRGYLSQRKSETQTENKELGCLLASVAKNSKLLSENANQYRTPAELAVRLFAEQSGHLRNKGGDYTHTFNRLDLQKELHLLFEQQRTFGNPFASAELQSKVDGLLMMQRSALQGEAVLKMLGKCTFEPSEYKAAKHTYSAERFIWLTKLNNLRILENGTERALNEAERKLLLDEPYKKAKLTYSQARKLLDMSHDATFKGLRYGKDSEGLNAENGALMEMKAYHKIRTVLDKAGLKGEWENRIRNPEILDKIGTAFSLYKTDEDIQAALADLRLPENVLNALLAGLNFDKFIQLSLKALSNIMPLMERGIRYDEACKEVYGDHRALAESKNQMLLPPIPANEIRNPVVLRTLTQTRKVINAIIRRYGSPQRVHIETARELGKSFKDRKEIEKRQEENRKERERAAEHFKELFPHFAGEPKGGDILKLRLYEQQQGKCLYSSIPIDLGRLNEKGYVEIDHALPFSRTWDDSFNNKVLVLGSENQKKRNQTPYEYLDGASNSQRWREFQARLQGCRFSYAKKQRIQTAKLDSKTEQGFLERNLNDTRYIARFLCGFIEENLHLQGEGKRRVFASNGQITALLRGLWGLKKVREENDRHHALDAIVVACSTVSMQQKITKAMQRRETLETVDTETGEVKTRIPQPWDFFRQEVMMRVFSDTPHEELAEKLSGRPEALHDFVSPLFVSRAPNRKMTGQGHLETVKSAKRLSENISVVRKPLTALKLKDIENIVGYPDREPALYQALRERLQAYKDDPVKAFAEPFYKPAKNGGQGSLVKAVRVKDVQKTGVMVRKDRGGIARGIADNATMVRVDVFGKKGKNYLVPVYAWQVAKGILPNRAVVAYADEADWDEMDDSYEFKFTLYPNDLVEIISKKGRIFGYYSGLNRATGAIDIKEHDLSKEKAKNGIHQSVGVKTVLSFQKYQVDPLGKEICLCKVEKHPELNSKKKK

SEQ ID NO: 584 - protein, 1078 aa, Artificial Sequence
  Cas9
MGYLIGLDIGITSVGYAVLQTDFKGNPYKILLMNTVIFPVAEAPKTGESLAAPVRQKRSSRRTNRRTKFRKLRVQKLFVRFGLLESADVATFLNQKVPHQDIWQLRKDALNRKLSNRELFEILYFFVGHRGFKSNRRSEVTGKQPKDNQVVLTSIHDRGNTLNDFDSLGEMMQELPEFKTIKHNKAYRPDNTIYPLRAWIEHELSAIFSVQQKNNRQITDNFITQYLDIFRSQRDFDQGPAAPSRFGGNMIERMVGPDSLDAHEKRAAKLTNTFFRFNFLSTLNNLKIQLTLGAEFHPLTTPQREIVLQAATLKSLNYKQIRHKLQLPDSARFNLVPYQSNEDPIKTESKHYLFKRKALTQIEAVTDNPQLIDKIGTILAYFKGDKTRQEKLSALNLSRAEIKQLLPINQPGFGNLSLKTMHKILPYLEQGHLYHEAAQLAGYDFQNNLVDRQYLRDNLKNPVVNRAIGKTIKVVNAIIKKYGDPDAIHIELTREIKHSHEERQKIARQMNTNMDQNDKVAEHLRENGIPVNGQNIIKSKLFYEQKGIDLYSGQQINEQDLYTEDHYQVDHIIPYSISFNDSFTNKTVTRTSNNQNKANRLPLEYLSEEKQDAFRARVMSNISNYRKRQNLLKEGITEDNRQQWKTRNINDTGYINRLLSQYLRNNVQFTKKSHNPVFTVNGATTAYIRKRYGIIKNRQATDLHHAVDAVIIGCISNTFVSRLAKYSEAQEARYHKQLWQITQYRQEHKDLSTIEYQELIKQFPLPWPDFRHELMARLSTDPAKMMAHHTWEHYTDEEISQLKPAFVIRSANHKVTGSAHDDTIYSKKLYDQRGVGLLRTSLQNLKYDSKKDGIKNYERLKDGSNSLVYDSLLRALKEHDGNAKKAFPDNQLLISTGNHQQIITHVKTVKKITHPIEVNRDTAIAIGGRMIRVDIFKQAKAQKLIGIPVYVNDTVKPTLPNRACTSGKRYSDWYQLTRQDQFLCSLVSNDLVLVETASPLKVTNNITNEEVQTTQLLCYFSSFNIANAQINFHSINNDSSINPIVLNKVTYLTKYQLDYLGNYFPVKHESRKTFNRKR

SEQ ID NO: 585 - protein, 1078 aa, Artificial Sequence
  Cas9
MHTRLALDIGTTSIGWILYELVNGQPASILDGGTRIFSDGREAKTGHSLAVGRRTARGMRRRRDRYLRRRAALMKRLAAIGLMPESPEAAAQLATLDPYELRARGLDHPLPPEHLGRALFHLNQRRGFKSNRRTDKGNNEGGMIADASARLEQAMMAAGARSYGEFLHKRRAEATAPRATPAVRTRINPHLTGEDGKEQPGYDFYPDRKHLEDEFHRLWEAQARHNPDLTPAMGDLLFQTIFHQRPLKAPAVGRCLFLDEPRLPKAHPLTQQRTLYETVNMLRIAPPGQPKRRLSRVQRDQIVHALNNRKILASPGKNVLTLAAIGKLLKLRPGEAFSLDTANRDAIACDPVRMSLAYEGRFGPQWSALSVESQWELIQRLRDDQDGAALVDWIMDRYGFDRDRARAIADAPLPEGFGRLGETATRAVLAVLIGGTTEQEVLTYSEAVAACGWDHSRLGTGEVLDRLPYYGQVLDRHVLPGTGRPEDDEITRFGRITNPTVHIGLGQVKRLVNKVIDAWGRPHEMVVELARDLKMSEDQKRNLAKVNAQNQRAAEMRSAKLIGDLKIEDNGRNRGILRVWEESAADVLHRCCPYTGAQISASMLFDGSCDIDHILPYSRTLDDGFNNRVICLKSANREKRNLTPWEAWGNTPKWAAIEANLKNLPPAKAWRFAPDAMLRYEGERDFTARALVDTQYLSRLAREYLECLYAEDIDPGPHSGKKPRRPIWVVTGKLTELLRRHWGLNSLLPDAHRGTAKAKNRLDHRHHMIDAAVVGATDHATVQRIANMAKGNVENGLEDLAGTILPPWPGLRDDLKARLERTIVSHRGNHGAIDPAARKQGRDTTSGQLHNDTAYGLTGETLKGVPLVVNRKPIDMLTPAMIDKIRDPHLSRWLTAVTKGKEGKDFKAAVEAFRAHPGPYRGIRRVRLIEPVEVIRIKDRNGRPYKGYKGDSNQCYEVWCLPDRTLTHHVVSTFAAHQGQTGKPHPAAKRLARLYKGDMVRLDRSKFGSVIATVEKFDRNGQLELVPHNEGNADQRYRKDKSDSVFIRLRAATFIASGARRVIVDEMGRIRDPGPGKH

SEQ ID NO: 586 - protein, 1079 aa, Artificial Sequence
  Cas9
MKYGIGLDCGINSVGYCIMELNSDDEPKRIVRLNSRIFTEAENPKDGSSLAAPRREARGLRRRIRRHKHRLERIRALLVRENIVTQAELDNMFSGTLSDIYELRTAALDAPLNNIEFARVLINLAQRRGFKSNRKSEKSSSDKETGKLLSAIKKNKESIEAGGYRTVGEMLFKDERYAKHKRNKGEAYLNTVSRDMIEAEIHAVFASQRNFGMPFANEKIENEYTDIALSQRPFDLGPGEGPENCKSPYAGKQIKNMIGQCTFFPEEKRAVKASYSFQLFSLLQGINNITLVSSDGNTFPLSQEQRKTLKDYCFKTANVTYASIRKVLQIPQEYTFKNITYTDDGIEKSEKKTKFQHLKPYHEMKKVLGSAIQTLTPEELDEIGEIFTFYKDETIIIKQLEETEIDKSLYDLLLQLPTFEKAGHISTKACKMIIPFLEEGKTYDKACECAGLNFKAHTNMQKQMLLPAKSDELNDVVNPVVRRAISQTIKVVNAIIREMGTSPTYINIELARELSKSKKERDEINKKYKLNQAENERLKNEIIDNFKIKPNGQDIIKLKLWHEQDDGICPYTGVRIKYENLFDDGYAEIDHIIPYSLSFDDSFNNKILTTATQNRQKGNRIPLEYLPESEKDGFRVWVNSNIRNHRKRQNLLKEHFTEADKKEFKSRNLNDTRYLNKLLLNYINDNLLFTDFYNGKKKHVTSVNGAVTAYIRKRWGINKNREDGDLHHAVDAAVIACVTQGIINRITAYSARNEAPYDLNTETGEIKERFPLPYPNFKKELDARTTIEDEKRLKRVLMSFSNYSYDDVEKAKPCFVSRTPHRKVTGAAHEETIRSGKVEGFTVSKTELTKLKLTNGEIEGYYEPESDTLLYNALLQRLNEFGGDAKAAFADEFHKPKADGTPGPVVKKVKTIKRSSSNVKARNKNGLGVADNGSMIRIDVFYVENEGYYFVPIYVADTVKEMPNEACPFGKDKKKIMTDDDFLFSLYPNDLIKITAKKDMKFSLANKESGLPKNKYANEVLVYYSAADISNASISVIMHDNAYKFRGCGIKSLVKLEKYTVDPLGNVSKVNREKRMYFK

SEQ ID NO: 587 - protein, 1079 aa, Artificial Sequence
  Cas9
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 588 - protein, 1079 aa, Artificial Sequence
  Cas9
MDEEAKIQLSKESYEEELESLLEKSGEEFRDVFLQAKKVYDAILLSDILSTKKQNSKAKLSLGMIERYDSHKKDLEELKQFVKANLPEKTAIFFKDSSKNGYAGYIDGKTTQEDFYKFLKKELNGIAGSERFMEKVDQENFLLKQRTTANGVIPHQVHLTELKAIIERQKPYYPFLEEARDKMIRLLTFRIPYYVGPLAQGEETSSFAWLERKTPEKVTPWNATEVIDYSASAMKFIQRMINYDTYLPTEKVLPKHSILYQKYTIFNELTKVAYKDERGIKHQFSSKEKREIFKELFQKQRKVTVKKLQQFLSANYNIEDAEILGVDKAFNSSYATYHDFLDLAKPNTERVAELLEQPEMNAMFEDIVKILTIFEDREMIRTQLKKYQSVLGDGFFKKLVKKHYTGWGRLSERLINGIRDKKTNKTILDYLIDDDDFPYNRNRNFMQLINDDSLSFKEELANELALAGNQSLLEVVEALPGSPAIKKGIWQTLKIVEELIEIIGYNPKNIVVEMARENQRTNRSKPRLKALEEALKSFDSPLLKEQPVDNQALQKDRLYLYYLQNGKDMYTGEALDIDRLSEYDIDHIIPRSFIVDNSIDNKVLVSSKENRLKMDDVPDQKVVIRMRRYWEKLLRANLISERKFAYLTKLELTPEDKARFIQRQLVETRQITKHVAAILDQYFNQPEESKNKGIRIITLKSSLVSQFRKTFGIHKVREINNHHHAHDAYLNGVVAIALLKKYPKLEPEFVYGNYTKFNLATENKATAKKEFYSNILRFFEKEEYSYDENGEIFWDKARHIPQIKKVISSHQVNIVKKVEVQTGGFYKETVNPKGKPDKLIQRKAGWDVSKYGGFGSPVVAYAVAFIYEKGKARKKAKAIEGITIMKQSLFEQDPIGFLSNKGYSNVTKFIKLSKYTLYELENGRRRMVASHKEAQKANSFILPEKLVTLLFYAQHYDEIAHKESFDYVNDHLSEFREILDQVIDFSNRYTIAAKNTEKIAELFEQNQESTVQSLSQSFINLMQLNAMGAPADFKFFDVIIPRKRYPSLTEIWESTIIYQSITGLRETRTRMATLWDGEQ

SEQ ID NO: 589 - protein, 1079 aa, Artificial Sequence
  Cas9
MDEEAKIQLSKESYEEELESLLEKSGEEFRDVFLQAKKVYDAILLSDILSTKKQNSKAKLSLGMIERYDSHKKDLEELKQFVKANLPEKTAIFFKDSSKNGYAGYIDGKTTQEDFYKFLKKELNGIAGSERFMEKVDQENFLLKQRTTANGVIPHQVHLTELKAIIERQKPYYPSLEEARDKMIRLLTFRIPYYVGPLAQGEETSSFAWLERKTPEKVTPWNATEVIDYSASAMKFIQRMINYDTYLPTEKVLPKHSILYQKYTIFNELTKVAYKDERGIKHQFSSKEKREIFKELFQKQRKVTVKKLQQFLSANYNIEDAEILGVDKAFNSSYATYHDFLDLAKPNTERVAELLEQPEMNAMFEDIVKILTIFEDREMIRTQLKKYQSVLGDGFFKKLVKKHYTGWGRLSERLINGIRDKKTNKTILDYLIDDDDFPYNRNRNFMQLINDDSLSFKEELANELALAGNQSLLEVVEALLGSPAIKKGIWQTLKIVEELIEIIGYNPKNIVVEMARENQRTNRSKPRLKALEEALKSFDSPLLKEQPVDNQALQKDRLYLYYLQNGKDMYTGEALDIDRLSEYDIDHIIPRSFIVDNSIDNKVLVSSKENRLKMDDVPDQKVVIRMRRYWEKLLRANLISERKFAYLTKLELTPEDKARFIQRQLVETRQITKHVAAILDQYFNQPEESKNKGIRIITLKSSLVSQFRKTFGINKVREINNHHHAHDAYLNGVVAIALLKKYPKLEPEFVYGNYTKFNLATENKATAKKEFYSNILRFFEKEEYSYDENGEIFWDKARHIPQIKKVISSHQVNIVKKVEVQTGGFYKETVNPKGKPDKLIQRKAGWDVSKYGGFGSPVVAYAVAFIYEKGKARKKAKAIEGITIMKQSLFEQDPIGFLSNKGYSNVTKFIKLSKYTLYELENGRRRMVASHKEAQKANSFILPEKLVTLLYHAQHYDEIAHKESFDYVNDHLSEFREILDQVIDFSNRYTIAAKNTEKIAELFEQNQESTVQSLSQSFINLMQLNAMGAPADFKFFDVIIPRKRYPSLTEIWESTIIYQSITGLRETRTRMATLWDGEQ

SEQ ID NO: 590 - protein, 1080 aa, Artificial Sequence
  Cas9
MKTSFAFDIGTNSIGWCVLALDNANLPYRILDAGVRIFSDGREPKSGTSLAEGRRLARGMSRRRDRYKRRRKAVIRTLIEYGLMPDDPAARRALVAETNDKAPGKIASDVYALRARALDDKLPLHHIGRALFHINQRRGFKSNRKTDKRDNDQGKIASGISRLRDKLASEGMRTLGEYLNHRHQAGNWVRVRPSRVPGKDDKEEDGYGFYPERALLQDEFNAIWTAQAAHYPDVLTEERRTHLETIIFFQRPLKPVQVGKCSFNPGEERLPRAHPLFQEFRLYKEVNELELVDRNQDHHKLSLDQRDALIAQLKTQREAAYSALRKTARAPLGTRFNKETESRTKMKGDEVAAELSAKTRFGQAWISMPLEERWIIVDTLRRVEDPLELTAWLEQHYGLDGEHIDAILAARLPEGYGRLGETALTEILVELKAAVISEAEAARRAGYDHALLQRGAGLEALPKYQEVIARRIPPGTGNPDDPYDVEKGRITNPTVHIGLNQLQKVLNALIRRYGKPEQIAIELARELKLNDEQKREKNIEIARNTRAAEQRSAKLVELGVPDTGYNRVLLKLWEELNLRAPENRVCIYCGEPINIETLFSSAVDIDHILPWSKTLDDSQANRLVCHVACNRQKANYAPAEVPQWQGRYDDILARANTLPLNKRWRFGRDAMKKFADEETFLARQLTDTQYLSRLAHAYMAALYPDEEPDAQGVLARKNHVRVITGRMTEMLRRQWGLNSLLADHNQKNRNDHRHHAIDAAVVGVTTRALLQRIATVAGGREAQALEETIGKIEPPWPGFRDELQAVIKRIVVSHKPDHGTLPKPGQGGQTAGQLHNDTAYGLTGETDSRGTPIVVRRKPFTSLTEKDLPSIRDRQLAQALGSAIAGRSGKELQAALEQFRDRDDYKSIRHVRVVEPLNVIPIRDGTGRAYKAYKGDANYRYDVWELPNGKWMHEVVSMFDAHDRSWTSAVHIHHPAARRVLSLKQNDMVAYDHPQDGPTIGRVVKFSQSGQMTFAPHKEAGALKARDADPEDRFRYFYKSGSAMKDIGLRQVRVDEIGRVFDPGPRDKEARNARKKKSTD

SEQ ID NO: 591 - protein, 1080 aa, Artificial Sequence
  Cas9
MAKSFAFDMGTNSIGWAVLGLDSAGDPDSIEGAGVRIFSDGREPKSGASLAEGRRIARGMSRRRERYKARRKALIRTLGDYGLMPLERAARRALVAETNDRSFGLVAQDVYALRARALVEKLPPYHLGRALFHLNQRRGFKSNRKTDGRDNELGMIATGIAALDAQLNGRTLGQYLHEMRGADPRQRGQVRVRPHLEINDKGREIAAYGFYPQRAMLEREFNAIWAAQAPHHPELLSEERRAHLFQVIFYQRPLKQPDPGRCSFNPAEPRLAKAHPLFQRFRLVKEINELRIVTGSNSQGVPLTLEQRDILLTLLRDKKASSFKTLLAKIIKGQPEARFNKASDSRDKMKGDELAATMSDKTRFGQAWFAMPEAEQWRIIAKLRDIDDPLELNAWLESEYGLAPERRDAVANALLPQGYGRLGETALRTMLDYLEAAVISEAEAAAQAGYDHALARRGAGLDQLPKYQEVLGRRIPPGSGEPNDPYDIRMGRISNPTVHIALNQLRRVVNALIRKYGKPAEIAIELARDLKLSEEQKREVNATIAKNTRDAERRAVRLADEGIDNTGHNRALLRFWEELAADPLDRVCVYCGGGIGAASLFNGSVDIDHILPWSRTLDDSRANRILVHNSCNRLKRNFAPFEVPEWREIYQDILVRAAKLPANKSWRFAPDAMDRFEGEKDFLARQLTDTQYLARMAHEYLAALYPDEEPDEWGVFARGNHVRVVPGRLTEMLRRAWGLNAILSDDNRKNRNDHRHHAIDAVVVGVTTRDMLNKISQAAGRGADMGAADALRRFDPPWPSFHQAVRAAVERILVSHRADHGTLPGTDGQGSTAGQLHNDTAYGLTGETRKGLAVVVRRKPYLSLEPRDIETIRDPQLRDHLATETYGLAGAEFTAALKRLQQTDKFYAGIRRVRVTEALSVIPIRDATGHAYKAYKGDANFRYDVWELPNGKWVPEVISMFDAHDRGWVSQVHAANPAARRVLSLRQNDMVAYQHPEQGLVYGRVVKFGQSGQMTFAAHHEGGSLKSRDADRDDPFKYFYKSAGTMKDIGLRQIRVDEIGRVQDPGPQDRDSKRVRKSDR

SEQ ID NO: 592 - protein, 1081 aa, Artificial Sequence
  Cas9
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAKLALNKFEKESGHIRNQRGDYSHTFSRKDLQAELNLLFEKQKEFGNPHISDGLKEGIETLLMTQRPALSGDAVQKMLGHCTFEPTEPKAAKNTYTAERFVWLTKLNNLRILEQGSEQPLTDTQRAKLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYNEACAEIYGDHYGKKNTEEKIYLPPIPADEIRNPVVLRALSQARKVINGVVRRYGSPARIHIETAREVGKSFKDRKEIEKRQEENRKDREKAAAKFQEYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 593 - protein, 1081 aa, Artificial Sequence
  Cas9
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVADNAHALQTGDFRTPAELALNKFEKESGHIRNRRGDYSHTFSRKDLQAELDLLFEKQKEFGNPHISDDLKEGIETLLMTQRPALSGDAVQKMLGHCTFEPTEPKAAKNTYTAERFVWLTKLNNLRILEQGSERPLTDTERATLMDEPYRKSKLTYAQARKLLELDDTAFFKGLRYGKDNAEASTLMEMKAYHAISRALEKEGLKDKKSPLNLSPELQDEIGTAFSLFKTDEDITGRLKDRVQPEILEVLLKHISFDKFVQISLKALRRIVPLMEQGKRYDEACAEIYGDHDGKKNTEEKIYLPPIPADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENNRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 594 - protein, 1081 aa, Artificial Sequence
  Cas9
MTAFKPNPINYILGLDIGIASVGWAMVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELAVNKFEKESGHIRNQRGDYSHTFSRKDLQAELVLLFEKQKEFGNPHISDGLKEGIETLLMAQRPALSGDAVQKMLGYCTFEPTEPKAAKNTYTAERFIWLTKLNNLRILEQGSERPLTDTERATLIDMPYKNKLTYAKARELLGLDDTAFFKGLRYGKDNAESATLMEMKAYHAIRRALEKEGLKDKKSPLSLSPELQDEIGTAFSLFKTDEDITGRLKGCLQPEILDALLKHINFDKFVQISLKALRRIVPLMEQGKRYDEACAETYGDHYGEKNSEEMLYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKAIDIRRLNGKGYVEIDHALPFSRTWDDSFNNKVLVLGSENQNKGNRTPYEYLNGKDNSREWLEFKARVETSRFPHSKKQRVLLQKFDEKGFKERNLNDTRYVNRFLCQFVADHMQLTGKGKRRVFASNGQITNLLRGFWGLHKVRAENDRHHALDAVVVACSTVAMQQKITCFVRYKEMNAFDGKTVDKETGEVLHQKTHFPQPWEFFAQEVMIRVFGKPDGKPEFEEADTPEKLRALLAEKLSSRPEAVHEYVTPLFVSRAPNRKMSGAHKDTLRSAKRFVKHNEKISVKRVWLTEIKLADLENMVNYKNGREIELYEALKARLGAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLMQKYQIDELGKEIRPCRLKKRPPVR

SEQ ID NO: 595 - protein, 1081 aa, Artificial Sequence
  Cas9
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 596 - protein, 1081 aa, Artificial Sequence
  Cas9
MLKRVLGIDVGISSIGWALLEFQGDIDNKDLPSGKILASGVRVFTQAENPKNGESLAKPRRDARLARRRTRRRAQRLTDIKDLFFKYKLVTGISRNKINSIYKTEENKKDPWTLRKEALYRKLDGEEFARVLTHIAKHRGFKSMRKSEEEGSDTKAKETQRVLTEIGKNKDTLKTGIWQTAGEMIASRPKGDARRNKTDSYKNSISRELLQDETKIIFEKQRGMNSQFTSADLEKEYSDIAFHQAPIQSMLKMVGGCTFEKDEEGKRLKRAPKNSYSAEVFTALTKINNLVLKTKTANINDRFLTTEERKKALELCHSNAKVTFKQLRGELGLPEDWIFNTVDYAKKPKKTAVKETEPESACFFQMRGYNEIRKSVGKDLWTEISMKKEILNSIVTTLATEKSDEAIKAQLKKSEVPDEIAEKVLGLNFRGFLHLSIKALDKIIPFMMAGDKYTDACDKAGYKEQISGIKKIFLRKLNDEENEQITNPVAKRAITQFRKVINAIIREYGKFDQMNIELARDLAKSYDDRKKIKEGQEDFRAEKDRAAQRCKDNGLDPNSKDNLSKYRLWEQQDNGFCIYCGKPIELQRLAEQGYCEVDHILPYSRSLDDSQHNKVLAHIHDNQQKKNQIPFEHFGGDGPKWEEFVGRLNSQFKNLPKSKLNRLVKRKFDEKDMEGFKERNINDTRYISRFIKNFVENHLEFAESAQKQKVFVRSGSLTAFLRHQWGLIKKRDESDRHHALDALVTACATQAMVKSTAITAQKMESYNWINKEKPRMPLPWLNFRDDVQKSLDAVFVSRAPRHKVGGAAHKETIRSIRKCGEENLIIEKTPLVDIATKSGIKLKDIEKLYKKEQNRKLYETLKERLEQNGNDPVKAFGNPDDPVRMPTNDLTKTGPIIKSIKLITNKKSGLNVRAGIADNGEIARLDVYERKGKFYLIPNYVADFANKELPKKAIKANTPETEWPIIDRNYNFKFSLFKDDLISIKQKLDSPEEFYYYKGPDVSTASITVESVDRKRLWEEKKKGKIENVFHTRIGTKTLKSFRKFNLDILGTKAPVEIKKETWVGVIRKNGVANNTGNKAM

SEQ ID NO: 597 - protein, 1082 aa, Artificial Sequence
  Cas9
MAAFKPNPMNYILGLDIGIASVGWAMVEIDKEENPIRLIDLGVRVFERAEVPKTGDSLAMARRLARSVRRLTRRRAHRLLRARRLLKREGVLQDADFDENGLVKSLPNTPWQLRAAALDRKLTCLEWSAVLLHLIKHRGYLSQRKNEGETADKELGALLKGVADNAHALQTGDFRTPAELALNKFEKESGHIRNQRGDYSHTFSRKDLQAELNLLFEKQKEFSNPHVSDSLKEGIETLLMAQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEAPTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYCKKNAEEKIYLPPIPADEIRNPVVLRALSQARKVINCVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKGLEKMVNREREPKLYDALKAQLETHKDNPAKAFAEPFYKYDKAGNRTQQVKAVRIEQVQKTGVWVRNHNGIADNATMVRVDVFEKGGKYYLVPIYSWQVAKGILPDRAVVAFKDEEDWTVMDDSFEFRFVLYANDLIKLTAKKNEFLGYFVSLNRATGAIDIRTHDTDSTKGKNGIFQSVGVKTALSFQKNQIDELGKEIRPCRLKKRPPVR

SEQ ID NO: 598 - protein, 1082 aa, Artificial Sequence
  Cas9
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 599 - protein, 1082 aa, Artificial Sequence
  Cas9
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGEEIRPCRLKKRPPVR

SEQ ID NO: 600 - protein, 1082 aa, Artificial Sequence; identical to SEQ ID NO: 438
  Cas9

SEQ ID NO: 601 - protein, 1082 aa, Artificial Sequence
  Cas9
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 602 - protein, 1082 aa, Artificial Sequence
  Cas9
MAAFKPNPINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTLWQLRAAALDRKLTPLEWSAVLLHLIKHRGYLSQRKNEGETADKELGALLKGVAGNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPTEPKAAKNTYTTERFIWLTKLNNLRILEQGSERPLTDTERATLMDEPYRKSKLTYAQARKLLELDDIAFFKGLRYGKDNAEASTLMEMKAYHAISRALEKEGLKDKKSPLNLSPELQDEIGTAFSLFKTDEDITGRLKDRIQPEILEALLKHINFDKFVQISLKALRRIVPLMEQGKRYDEACAEIYGDHYGKKNTEEKIDLPPIPADEIHNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLTEKLSSRPEAVHEYVTPLFVSRAPNRKMSGQGHMETVKSAKRLDEGISVLRVPLTQLKLKDLEKMVNREREPKLYEALKARLEAHKDDPAKAFAEPFYKYDKAGNRTQQVKAMRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 603 - protein, 1082 aa, Artificial Sequence
  Cas9
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPAEPKAAKNTYTAERFIWLTKLNNLRILEQGSERPLTDTERTTLIDEPYRKSKLTYAQARKLLELDNTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIDLPPIPADEIRNPVVLRALSQARKVINGVVRRYGSPARIHIETAREVGKSFKDRKEIEKRQEENRKDREKAATKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 604 - protein, 1082 aa, Artificial Sequence
  Cas9
MAAFKPNPMNYILGLDIGIASVGWAIVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNTHALQTGDFRTPAELALNKFEKESGHIRNQRGDYSHTFNRKDLQAELNLLFEKQKEFGNPHVSDGLKEGIETLLMTQRPALSGDAVQKMLGHCTFEPTEPKAAKNTYTAERFVWLTKLNNLRILEQGSERPLTDTERATLMDEPYRKSKLTYAQARKLLDLDDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGNRYDEACTEIYGDHYGKKNTEEKIYLPPIPADEIRNPVVLRALSQARKVINGVVRRYGSPARIHIETAREVGKSFKDRKEIEKRQEENRKDREKSAAKFREYFPNFVGEPKSKDILKLRLYEQQHGKCLYSGKEINLGRLNEKGYVEIDHALPFSRTWDDSFNNKVLALGSENQNKGNQTPYEYFNGKDNSREWQEFKARVETSRFPRSKKQRILLQKFDEDGFKERNLNDTRYINRFLCQFVADHMLLTGKGKRRVFASNGQITNLLRGFWGLRKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHKYVTPLFISRAPNRKMSGQGHMETVKSAKRLDEGISVLRVPLTQLKLKDLEKMVNREREPKLYEALKARLEAHKDDPAKAFAEPFYKYDKAGNRTQQVKAVRVEQVQKTGVWVHNHNGIADNATIVRVDVFEKGGKYYLVPIYSWQVAKGILPDRAVVQGKDEEDWTVMDDSFEFKFVLYANDLIKLTAKKNEFLGYFVSLNRATGAIDIRTHDTDSTKGKNGIFQSVGVKTALSFQKYQIDELGKEIRPCRLKKRPPVR

SEQ ID NO: 605 - protein, 1082 aa, Artificial Sequence
  Cas9
MAAFKPNSINYILGLDIGIASVGWAMVEIDKEENPIRLIDLGVRVFERAEVPKTGDSLAAARRLARSVRRLTRRRAHRLLRTRRLLKREGVLQAANFDKNGLIKSLPNTLWQLRAAALDRKLTPLEWSAVLLHLIKHRGYLSQRKNEGETADKELGALLKGVAGNAHALQTGDFRTPAELALNKFEKESGHIRNQRGDYSHTFSRKDLQAELNLLFEKQKEFGNPHISGGLKEGIETLLMTQRPALSGDAVQKMLGHCTFEPTEPKAAKNTYTTERFIWLTKLNNLRILEQGSERPLTDTERATLMDEPYRKSKLTYAQARKLLSLEDTAFFKGLRYGKDNAEASTLMEMKAYHTISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 606 - protein, 1082 aa, Artificial Sequence
  Cas9
MAAFKPNPINYILGLDIGIASVGWAMVEIDEEENPIRLIDLGVRVFERAEVPKTGDSLAMVRRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHISGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 607 - protein, 1082 aa, Artificial Sequence
  Cas9
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 608 - protein, 1084 aa, Artificial Sequence
  Cas9
MKNTLYGIGLDIGVASVGWAVVGLNGTGEPVGLHRLGVRIFDKAEQPKTGESLAAPRRMARGMRRRLRRKALRRADVYALLERSGLSTREALAHMFEAGGLEDIYALRTRALDEPVGKAEFSRILLHLAQRRGFKSNRRTASDGEDGRLLAAVNENRRRMAQGGWRTVGEMLYRHEAFALHKRNKADEYLSTVGRDMVAEEASLLFQRQRELGCAWATPELQAEYLSILLRQRSFDEGPGGNSPYGGNQVEKMVGRCTFEPDEPRAAKAAYSFEYFSLLQKINHIRLVENGETRPLTQQQRQQLLSLAHKTPDVSLARIRKELALPETVQFNGVRCRANETLEESEKKEKFACLPAYHKMRKALDGVVKGRISSLSISQRDAAATALSLYKNEDTLRAKLTEAGFQAPEIDALAGLTGFSKFGHLSLKACRKLIPHLEQGLTYDQACSAAGYDFKGHGAGERAFTLPAAAPEMEQITSPVVRRAVAQTIKVVNGIIREMDASPAWVRIELARELSKTFGERQEMDRSMRENAAQNERLMQELRDTFHLLSPTGQDLVKYRLWKEQDGVCAYSLRRLDVERLFEPGYVDVDHIVPYSLSFDDRRSNKVLVLSSENRQKGNRLPLQYLQGKRREDFIVWTNSSVRDYRKRQNLLREKLSGDEAEGFRQRNLQDTQHMARFLYNYISDHLAFAQSEALGKKRVFAVSGAVTSHLRKRWGLSKVRADGDLHHALDAAVIACTTDGMIRRISGYYGHIEGEYLQDADGAGSQHARTKERFPAPWPRFRDELIVRLSEQPGEHLLDINPEFYCEYGTEHIRPVFVSRMPRRKVTGPGHKETIKGAAAADEGLLTVRKALTELKLDKDGEIKDYYMPSSDTLLYEALKAQLRRFGGDSKKAFAEPFYKPKADGTPGPLVRKVKTTEKATLTVPVHGGAASNDTMVRVDVFLVPGDGYYWVPVYTADTLKPELPNRAVVQGKPYSEWKEMREEDFIFSLYPNDLVYVEHKSGLKFTLQNADSTLEKTRTQTSAFVYFVGGSISTASITIRTHDNAYGIPSLGVKTLKTFHKYQVDVLGNVFPVHKETRQKFR

SEQ ID NO: 609 - protein, 1084 aa, Artificial Sequence
  Cas9
MKNTLYGIGLDIGVASVGWAVVGLNGTGEPVGLHRLGVRIFDKAEQPKTGESLAAPRRMARGMRRRLRRKALRRADVYALLERSGLSTREALAQMFEAGGLEDIYALRTRALDEPVGKAEFSRILLHLAQRRGFKSNRRTASDGEDGRLLAAVNENRRRMAQGGWRTVGEMLYRHEAFALHKRNKADDYLSTVGRDMVAEEASLLFQRQRELGCAWATPELQAEYLSILLRQRSFDEGPGGDSPYGGNQVEKMVGRCTFEPDEPRAAKAAYSFEYFSLLQKINHIRLAENGETRPLTQPQRQQLLSLAHKTPDMSLARIRKELALPETVQFNGVRCRANETLEESEKKEKFACLPAYHKMRKALGGVVKGRISSLSISQRDAAATALSLYKNEDTLRAKLTEAGFQAPEIDALAGLTGFSKFGHLSLKACRKLIPHLEQGLTYDQACSAAGYDFKGHGAGERAFTLPAAAPEMEQITSPVVRRAVAQTIKVVNGIIREMDASPAWVRIELARELSKTFGERQEMDRSMRENAAKNERLMQELRDTFHLLSPTGQDLVKYRLWKEQDGVCAYSLQRLDVEQLFEPGYVDVDHIVPYSLSFDDRRSNKVLVLSSENRQKGNRLPLQYLQGKRREDFIVWTNSSVHDYRKRQNLLREKLSDDEAEGFRQRNLQDTQHMARFLYNYISDHLAFAQSEALGKKRVFAVSGAVTSHLRKRWGLSKVRADGDLHHALDAAVVACTTDGMIRRISGYYGHIEGEYFQDADGAGSQHARTKERFPAPWPRFRDELIVRLSEQPGEPLLDINPAFYCEYGTEHIRPVFVSRMPRRKVTGPSHKETVKGAAAADEGLLTVRKALTELKLDKDGEIKDYYMPSSDTLLYEALKAQLRRFGGDGKKAFAEPFYKPKADGTPGPLVRKVKTTEKATLTVPVHGGAASNDTMVRIDVFFMPGDGYYWVPLYVADTLKPELPNRAVVAHKPYSEWQEMREEDFVFSLYPNDLVYVEHKSELKFTVQNADSTLEKTRTQASAFVYFVSGGISGGTITVRTHDNSYGIPSLGLKTLKSLCKYQVDVLGNVFPVHKETRQKFR

SEQ ID NO: 610 - protein, 1084 aa, Artificial Sequence
  Cas9
MKNTLYGIGLDIGVASVGWAVVGLNGTGEPVGLHRLGVRIFDKAEQPKTGESLAAPRRMARGMRRRLRRKALRRADVYALLERSGLSTREELAQMFEAGGLEDIYALRTRALDEPVGKAEFSRILLHLAQRRGFKSNRRTASDGEDGRLLAAVNENRRRMAQGGWRTVGEMLYRHEAFALHKRNKADDYLSTVGRDMVAEEASILFERQRAMGCSWAAPELQAEYLSILLRQRSFDEGPGGNSPYGGNQVEKMVGRCTFEPDEPRAAKAAYSFEYFSLLQKLNHIRLAENGETRPLTQPQRQQLLSLAHKTPDISLARIRKELALPETVQFNGVRCRANETLEESEKKEKFACLPAYHKMRKALDGVVKGRISSLSISQRDAAATALSLYKNEDTLRAKLTEAGFQAPEIDALAGLTGFSKFGHLSLKACRKLIPHLEQGLTYDQACTAAGYDFKGHGAGERAFTLPAAAPEMEQITSPVVRRAVAQTIKVVNGIIREMDASPAWVRIELARELSKTFGERQEMDRSMRENAAQNERLMQELRDTFHLLSPTGQDLVKYRLWKEQDGVCAYSLRRLDVERLFEPGYVDVDHIVPYSLSFDDRRSNKVLVLSSENRQKGNRLPLQYLQGKRREDFIVWTNSSVHDYRKRQNLLREKLSGDEAEGFRQRNLQDTQHMARFLYNYISDHLAFAQSEALGKKRVFAVSGAVTSHLRKRWGLSKVRADGDLHHALDAAVVACTTDGMIRRISGYYGHIEGEYLQDADGAGSQHARTKERFPAPWPRFRDELIVRLSEQPAEPLLDINPEFYCEYGTEHIRPVFVSRMPRRKVTGPGHKETIKGAAAADEGLLTVRKALTELKLDKDGEIKDYYMPSSDTLLYEALKAQLRRFGGDGKKAFAEPFYKPKADGTPGPLVRKVKTTEKATLTVPVHGGAASNDTMVRVDVFLVPGDGYYWVPVYTADTLKPELPNRAVVQGKPYSEWKEMREEDFIFSLYPNDLVYVEHKSGLKFTLQNADSTLEKTRTQTSAFAYFVSGSISTASITIRTHDNAYGIPSLGVKTLKTFHKYQVDVLGNVFPVHKETRQKFR

SEQ ID NO: 611 - protein, 1084 aa, Artificial Sequence
  Cas9
MRLGLDIGTNSIGWWLYGTEGGRITEVVDGGVRIFSDGRDPQSKASLAVDRRAARSQRRRRDRYLRRKAALMKRMAQVGLMPADPAEAKVLEVLNPYELRASGLDGPLPLTHFGRALFHLNQRRGFKSNRKTDRGDNESGKIKDATARLDQAMMAKGARTYGEFLHMRRAAALDPKSVPSVRTRLTVARRDDAEKEEAGYDFYPDRKHLSEEFDKLWAAQARHAPDVLTEDLRDEIATIIFHQRPLKTPEVGLCLFTGQHGVPERDKRIPSAHPLNQRRILMETVNNLKVAAQGEPSRPLTREERDQIVHALDNKKHTKSLSGMTMKLKALGKVIKLRPEQGFTLETANRDAIACDPVRASLSHPDRFGARWSTLESAGQWDVVQRIRAVQSDAEHADLVGWLMDVHGLDRDHAEETANAPLPEGYGRLGLTATTRILAALEADVLNYSAAVAACGWHHSDGRTGEVLESLPYYGEILERHVIPGTGDPNDDDVKRYGRITNPTVHIGLNQLRRLVNRIITVYGRPDEIVVELARDLKLSEDQKKDVQRDIKKNTEAAIRRGKKLEEMGVPNTGANRMVLRLWEDLGDDVMTRNCPYTGKRISAGMLFDGSCDVDHILPYSRTLDDSFANRTLCLKEANRQKTDKTPWEAWGETEQWEAIAANLKNLPANKAWRFAPDAMERFEGEKDFSARALADTQYLSRIARAYLDALYDGDDGKSHVWVVPGRLTEMLRRHWGLNGVAALTDSDKQTVKAKNRTDHRHHAIDAAVVAATDRGLIKRIADMAKRDEFNGAEEVARSIPPPWEGFRDDVSAQVTRIIVSHRADHGRIDPAARKSGRDSTSGQLHNDTAYGIGRDGTVVSRKPLASLSPNDIVVTKRGANIRDVDLQKHLARVTHGLDGKAFEAALLAFAASPILPDNTDNPYFGLRRVRLEETLQESARVEVADQEGRPYKAYKGDSNHCYEIWCLPDGKIKPQVVTTYEAHQSGAEKKPHPAAKRLMRIFKRDMVMLERDGETIIGYVQKMKQNGSIFVAPHTEANADARDRDPKDDFKLIQLGAGSLVKAKARRVIVDEMGRLRDPGPPL

SEQ ID NO: 612 - protein, 1085 aa, Artificial Sequence
  Cas9
MDKGTNSIGWAALRLDEQGEPVGIIEAGVRIYADGREPKSGTSLAEGRRIARGMSRRRDRYKRRRRTVLNTLTEFGLMPATKAARKALVAETNDRRFGEVASNVYALRARALDEKLPLYQLGRALFHLNQRRGFKSNRKTDKRDNDQGKIASAISRLGRKLDEAGARTLGEFLHKQHAAGKWVRVRPSRVPGEDDKEEDGYGFYPERSFLEREFAAIWEAQAAFYPELLTEERRDHLHWVMFFQRPLKRPTVGKCSFHPDEDRLPKAHPLFQEFRLIKELNELEVVHRGDRREKLTPDQRDRLFNQLRTQRSSAFTALRKTIKAPTGTRFNKESDARDKLKGDEVAAEMSHKDRFGQAWIGMPLAERWAVVAMLLDTEDPLEVKAWLEERYGFAADRIDAIAAAKLPTGYGRLGETALRDMLDELRNGTVKDDAGRDVVLTERQAMDNIWGDNPALQRAVTDARELPPYQEVLGRRIPPGTGKPADPYDVQKGRLTNPTVHIGLNQLKRIVNVLMRRHGRPEQIALELARDLKLNEEQKAEKNREIARNTKAAEARGKKLEELGHANNGYNRVLLKLWEDLNLKQPENRECIYCGKAIGIGTLLSNQVDIDHILPWSKTLDDSQANRIVCHVECNRQKGNHAPAEVPQWHDRYDDILARAERLPRNKAWRFGREAMKKFKDDESFLARQLTDTQYLSRLAHEYLGALYPDEEPDEWGGPARRNHVRVIPGRMTEMLRRQWGLNAIISDHNQKNRNDHRHHAIDAIVVGVTTRRLLQRIATVAGGREALALEETIGKIEPPWPGFYDDVKAAIDRIVVSHKPDHGSLPKPGKPGRTAGQLHNDTAYGFTGEARNGVPIMVHRVPFASLTEKDIPSIRDRQLADALYAAISGISGKAELAAALARFSESGPYKGIRHVRVVEPVSVIAIKDQAGKAYKGYKGDANYRYDVWELPNGKWTHEVVSMFNAHRPDWQSEIRSKNPAARKVLSLHQNDMVAYEHPQDGYTIGRVVKFSAGGQMALAGNREGGALKSRDADPEDRFRYFYKSGGAMRDVQLRQVRVDETGRVFDPGPQDRESRNARKQNDAG

SEQ ID NO: 613 - protein, 1087 aa, Artificial Sequence
  Cas9
MRYKIGLDIGITSVGWAVMNLDIPRIEDLGVRIFDRAENPQTGESLALPRRLARSARRRLRRRKHRLERIRRLVIREGILTKEELDKLFEEKHEIDVWQLRVEALDRKLNNDELARVLLHLAKRRGFKSNRKSERSNKENSTMLKHIEENRAILSSYRTVGEMIVKDPKFALHKRNKGENYTNTIARDDLEREIRLIFSKQREFGNMSCTEEFENEYITIWASQRPVASKDDIEKKVGFCTFEPKEKRAPKATYTFQSFIAWEHINKLRLISPSGARGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIHSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYVEVDHVIPYSRSLDDSYTNKVLVLTRENREKGNRIPAEYLGVGTERWQQFETFVLTNKQFSKKKRDRLLRLHYDENEETEFKNRNLNDTRYISRFFANFIREHLKFAESDDKQKVYTVNGRVTAHLRSRWEFNKNREESDLHHAVDAVIVACTTPSDIAKVTAFYQRREQNKELAKKKEPHFPQPWPHFADELRARLSKHPKESIKALNLGNYDDQKLESLQPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPVIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKTVKTAAGEEINVKDVFVYYKTIDSANGGLELISHDHRFSLRGVGSRTLKRFEKYQVDVLGNIYKVRGEKRVGLASSAHSKPGKTIRPLQSTRD

SEQ ID NO: 614 - protein, 1087 aa, Artificial Sequence
  Cas9
MLRMKYAIGLDIGIASVGYAVLALDHEENPWGIIRLGSRIFDVAENPKDGASLALPRREARSVRRRLRRHHHRLERIKNLLINTEFITKDELLHLYDGNLSDVYELRVKALDYSVTNAELTRILLHLAQRRGFKSNRKSDANDKEAGQLLEAVSANAKRMQENHYRTVGEMFYKDDLFSKYKRNKGGTYLTTVHRDMIAAEARTILEKQFALGNNICTQDFIDKYLSILLSQRQFDEGPGEPSPYAGNQIANMIGKCTFEPNEYRAAKASYSFERFNLLQKVNHLRLLLEGKSIALDNEQRKKIIALAHDKADLRYSHIRKALGLDEKVLFNTITYNDDVSVIEKKTKFNFLQAYHQIKKVLAEDMQKLTTEQLDNIGQILSTYKSDNKRTEELSALGLEKKIIDALLGINGLSKFAHLSLKALRKINPYLEEGKIYNEACTAAGYDFKAHANTQKTELLPAYKEEMDDITSPVARRAIAQSIKVINAIIREQKGSPLYINIELAREMAKGFDERTQIDKANKENQAKNERIMERIRTEFHKANPTGMDLIKLKLWEEQDGRSPYSQKAISINRLFEPGYVDIDHIVPYSISFDDSFKNKVLVFSDENRDKGNRLPIAYLQSKFGAKAAENFMIWVQSNIKDYKKRQKLLKREITEEDINKFKERNLQDTKTISRFLYNYINDYLLFAPSDTGKKKRVTAVNGTITAYLRKRWGINKIRANGDKHHAVDAVVIACTTDKMIKDLSSFSRYHELEYTHTDTESFLVNSLTGEILKRFPYPWEDFRPELMARLSDNPADALRKLNLIFYHGIDLSTIKPIFVSRMPRHKVTGAAHKATIKSARCLDNGIVICKTSLQNLKLDKEGEIANYYAPESDTILYNALKERLRSYDNKPAKAFAEPFYKPKADGTPGPLVKKVKVYEKSTLNVAVQQNTAVADNDSMVRVDVFHVKGNGYYLVPIYIADTLKKELPNKAIVAYKPYADWPVMDDSNFIFSLYPNDLIKFEHKNSVKFAKVNKESTLNDFYSTKSEIVYFKGCNINTGAITIINHENTYVVSSLGVKTLPSLEKYQADVLGNYTKVKKEVRKPFR

SEQ ID NO: 615 - protein, 1087 aa, Artificial Sequence
  Cas9
MRYKIGLDIGITSVGWAVINLDIPRIEDLGVRIFDRAENPQTGESLALPRRLARSARRRLRRRKHRLERIRRLIIREGILTKEELDKLFEEKHEIDVWQLRVEALDRKLNNDELARVLLHLAKRRGFKSNRKSERSNKENSTMLKHIEENRAILSSYRTVGEMIVKDPKFALHKRNKGENYTNTIARDDLEREIRLIFSKQREFGNMSCTEEFENEYIAIWASQRPVASKDDIEKKVGFCTFEPKEKRAPKATYTFQSFIAWEHINKLRLISPSGTRGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIRSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYTEVDHVIPYSRSLDDSYTNKVLVLTKENREKGNRIPAEYLGVGTERWQQFETFVLTNKQFSKKKRDRLLRLHYDENEETEFKNRNLNDTRYISRFFANFIREHLKFAESDDKQKVYTVNGRVTAHLRSRWEFNKNREESDLHHAVDAVIVACTTPSDIAKVTAFYQRREQNKELAKKTEPHFPQPWPHFADELRARLSKHPKESIKALNLGNYDDQKLESLQPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPVIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKIIKTAGGEEIKIKDLFAYYKTIHSGTAGLELVSHDCSFSLSGVGSRTLKRFEKYQVDVLGNIYKVRGEKRVGLASSAHSKTGETIRPLQSTRD

SEQ ID NO: 616 - protein, 1087 aa, Artificial Sequence
  Cas9
MRYKIGLDIGITSVGWAVINLDLPRIEDLGVRIFDRAENPQTGESLALPRRLARSARRRLRRRRHRLERIRRLLTRENVLTQEELDKLFEKKHEIDVWQLRVEALDRKLNNDELARVLLHLAKRRGFKSNRKSERSNKENSTMLKHIEENRSILTGYRTVGEMIVRDPKFVLHKRNKGENYTNTIARDDLEREIQLIFARQREFGNMICTEAFENEYIAIWSSQRPVASKDDIEKKVGFCTFEPKEKRAPKATYTFQSFIAWEHINKLRLVSPSGTRELTDEERRLLYEQAFQKNKLTYHDIRTLLHLPDDTYFKGIVYDWGEPLKQNENIRFLELDAYHQIRKTVDKVYGRGKSSSFLPIDFDTFGYALTLFKDDAHIRSYLRNEYEQNGKRIANLANKVYDNELIEELLNLSFTKFGHLSLKALRNILPYMEQGEVYSSACERAGYTFTGPTKKQKTVLLPTIPPIANPVVMRALTQARKVVNAIIKKYGSPVSIHIELARDLSQTFDERKKTKKEQDENRKRNETAIRQLIEYGLTRNPTGHDIVKFKLWSEQNGRCAYSLQPIEIKRLLEPGYVEVDHVIPYSRSLDDSYTNKVLVLTKENREKGNRIPAEYLGVGTERWQQFETFVLTNKQFSKKKRDRLLRLHYDENEEAEWKNRSLNDTRYISRFFANFIREHLKFADSDDKQKVYTVNGGVTAHLRSRWDFNKNREESDLHHAVDAAIVACTTLSDIARVTAFYQRREQAKELAKKTEPHFPQPWPHFADELRARLSKNPKESIKALNLGNYDNEKLESLQPVFVSRMPKRSVTGAAHQETLRRYIGIDERSGKIQTVVKTKLSEIKLDASGHFPMYGKESDPRTYEAIRLRLLEHNNDPRKAFQEPLYKPKKNGELGPIIRTVKIIDTKNQVIPLNDGKTVAYNSNIVRVDVFEKDGKYYCVPVYTMDIMKKVLPNKAIEPNKPYSEWKEMTEDYTFRFSLYPNDLIRIELPREKTVKTTAGHEINIKDVFVYYKTIDSATGGLELISHDNSFSLRGIGSRTLKRFEKYQVDVLGNIYKVRGEKRVGLASSAHPETRETIRPLQSTRD

SEQ ID NO: 617 - protein, 1087 aa, Artificial Sequence
  Cas9
MKKLVLGLDIGVASVGWGIIDAENGDVVDTGVRLFSSRDASENESRRTSRQSRRLSRRKKHRRERIKQLLLAHDMDICDIVNENPYELRVKGLNEKLEVSEIYVALTHLAKRRGVSYLDDVVEEGGTIKSEHLNKNMEEIKSGKMPCEIQLERFEKYGQVRGMIEINQDTEESSFLVNIFRTSDYIKEAKTILATQQKFHKQITNEFIDEYIHIMASKRDYFIGPGNEKSRTDYGVYRTNGDTWDNLFEILIGKCSVFPEETRAARSSYVAQEFNLLNDLNNLKISNLESGKLSASQKHDIVEKVKNSKKFGTKDLLKYIASVCECKIEDIGGCRVDKNRKPIMHTFENYRKVHNALNEAGVDLRLSETDYDELMKIMTLNSETLEIKKQCKEKLPQLTEDYLNVCLVLNKKGAFSGWHALSLKAMKLMMPELYGTSKNQMQIIHTMQLGKAYLKPLNQQKYLNSEAILEEIYNPIAARSIRQTIKVTNAILKKYGHLDSVIIEMPRDYQTSEDERKMIEKMQKENEKEKKAALKRAREEYPFPDEAFRNHKELATKLRLWYQQDQFCVYSGRKISVVDLVRNPNQFEIDHIIPQSVSLDDSLNNKVLCFSEENQKKGQQTPFYYHKGKSGNWTYEQYKLFVEKLFDKKKISNKKRELLLFEEDINKWDVRRGFIARNLVDTRYASRVILNSYQQYFGNHEMGTKVKVVRGKFTSQLRKKWRIFKDRNESHSHHAIDALIVAATANLRLWKKNTLGVSDEGKVYDKETGEILPFEKLTESEYNEMMNKEPYLNFKTKLQNIETKVKYSYRVSKKVNRKISDATIYSTRERDGIDYIVGKIKNIYDVKTYKDQFLKRYKKNKEQFLMYQHDPQTFAILENIMATYQDAENPFLAYKKEYGVIRKYSKKGGGSPVTSLKFIDKVLGQKIDLTAKNQAALPKNKKVVLQSITPYRADVYYDEIDKRYHLIGVKYSLFSFSKQGYVINPIAYQKLLEKEQIHSEMKFCFSLYREDIIEFGEDPDSLTRYRFWSKNESGKNKIEVKPIEKPNFEKQTVLTITKKIKILNKYQTDVLGNSFKAQEEKDPRNIE

SEQ ID NO: 618 - protein, 1087 aa, Artificial Sequence
  Cas9
MRYKIGLDIGITSVGWAVMNLDIPRIEDLGVRIFDRAENPQTGESLALPRRLARSARRRLRRRKHRLERIRRLVIREGILTKEELDKLFEEKHEIDVWQLRVEALDRKLNNDELARVLLHLAKRRGFKSNRKSERSNKENSTMLKHIEENRAILSSYRTVGEMIVKDPKFALHKRNKGENYTNTIARDDLEREIRLIFSKQREFGNMSCTEEFENEYITIWASQRPVASKDDIEKKVGFCTFEPKEKRAPKATYTFQSFIAWEHINKLRLISPSGARGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIHSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYVEVDHVIPYSRSLDDSYTNKVLVLTRENREKGNRIPAEYLGVGTERWQQFETFVLTNKQFSKKKRDRLLRLHYDENEETEFKNRNLNDTRYISRFFANFIREHLKFAESDDKQKVYTVNGRVTAHLRSRWEFNKNREESDLHHAVDAAIVACTTPSDIAKVTAFYQRREQNKELAKKTEPHFPQPWPHFADELRARLSKHPKESIKALNLGNYDDQKLESLQPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPVIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKTVKTAAGEEINVKDVFVYYKTIDSANGGLELISHDHRFSLRGVGSRTLKRFEKYQVDVLGNIYKVRGEKRVGLASSAHSKTGETVRPLQSTRD

SEQ ID NO: 619 - protein, 1087 aa, Artificial Sequence
  Cas9
MRYKIGLDIGITSVGWAVMNLDIPRIEDLGVRIFDRAENPQTGESLALPRRLARSARRRLRRRKHRLERIRRLVIREGILTKEELDKLFEEKHEIDVWQLRVEALDRKLNNDELARVLLHLAKRRGFKSNRKSERSNKENSTMLKHIEENRAILSSYRTVGEMIVKDPKFALHKRNKGENYTNTIARDDLEREIRLIFSKQREFGNMSCTEEFENEYITIWASQRPVASKDDIEKKVGFCTFEPKEKRAPKATYTFQSFIAWEHINKLRLISPSGARGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIHSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYVEVDHVIPYSRSLDDSYTNKVLVLTRENREKGNRIPAEYLGVGTERWQQFETFVLTNKQFSKKKRDRLLRLHYDENEETEFKNRNLNDTRYISRFFANFIREHLKFAESDDKQKVYTVNGRVTAHLRSRWEFNKNREESDLHHAVDAVIVACTTPSDIAKVTAFYQRREQNKELAKKTEPHFPQPWPHFADELRARLSKHPKESIKALNLGNYDDQKLESLQPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPVIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKTVKTAAGEEINVKDVFVYYKTIDSANGGLELISHDHRFSLRGVGSRTLKRFEKYQVDVLGNIYKVRGEKRVGLASSAHSKPGKTIRPLQSTRD

SEQ ID NO: 620 - protein, 1087 aa, Artificial Sequence
  Cas9
MRYKIGLDIGITSVGWAVINLDIPRIEDLGVRIFDRAENPQTGESLALPRRLARSARRRLRRRKHRLERIRRLIIREGILTKEELDKLFEEKHEIDVWQLRVEALDRKLNNDELARVLLHLAKRRGFKSNRKSERSNKENSTMLKHIEENRAILSGYRTVGEMIVKDPKFALHKRNKGENYTNTIARDDLEHEIRLIFSKQREFGNMSCTEKFENEYITIWASQRPVASKDDIEKKVGFCTFEPKEKRAPKATYTFQSFIAWEHINKLRLIFPSGARGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIHSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYVEVDHVIPYSRSLDDSYTNKVLVLTRENREKGNRIPAEYLGVGTERWQQFETFVLTNKQFSKKKRDRLLRLHYDENEETEFKNRNLNDTRYISRFFANFIREHLKFAESDDKQKVYTVNGRVTSHLRSRWDFNKNREESDLHHAVDAAIVACTTPSDIAKVTAFYQRREQNKELAKKTEPHFPQPWPHFADELRARLSKHPKESIKALNLGNYDDQKLESLQPVFVSRMPKRSVTGAAHQETLRRYIGIDERSGKIQTVVKTKLSEIKLDASGHFPMYGKESDPRTYEAIRQRLLEHNNDPKKAFQEPLYKPKKNGEPGPIIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKTVKTTTGEEINVKDVFVYYKTIDSATGGLELISHDNRFSLRGVGSRTLKRFEKYQVDVLGNIYKVRGEKRVGLASSAHSKTGETIRPLQSTRD

SEQ ID NO: 621 - protein, 1087 aa, Artificial Sequence
  Cas9
MRYKIGLDIGITSVGWAVINLDIPRIEDLGVRIFDRAENPQTGESLALPRRLARSARRRLRRRKHRLERIRRLLIREGVLTKEELDKLFEEKHEIDVWQLRVEALDRKLNNDELVRVLLHLAKRRGFKSNRQSERSNKENSTMLKHIEENRAILSGYRTVGEMIVKDPKFALHKRNKGENYTNTIARDDLEREIRLIFSKQREFGNMSCTEEFENEYIAIWASQRPVASKDDIEKKVGFCTFEPKEKRAPKATYTFQSFIAWEHINKLRLISPSGTRGLTDEERRLLYEQAFQKNKITYHDIRTLLHLPDDTYFKGIVYDWGESLKQNENIRFLELDAYHQIRKAIDKVYGKGKSSSFLPIDFDTFGYALTLFKDDADIRSYLRNEYEQNGKRIANLANKVYDNELIEELLNLSFTKFGHLSLKALRNILPYMEQGEVYSSACEKAGYTFTGPKKKQKTVLLPTIPPIVNPVVMRALTQARKVVNAIIKKYGSPVSIHIELARDLSQTFDERRKTKREQDENRKRNETAIRQLMEYGLTLNPTGLDIVKFKLWSEQNGRCAYSLQPIEIERLLEPGYVEVDHVIPYSRSLDDSYTNKVLVLTKENREKGNRIPAEYLGVGTERWQQFETFVLTNKQFSKKKRDRLLRLHYDENEEMEFKSRNLNDTRYISRFFANFIREHLKFAESDDKQKVYTVNGRVTSHLRSRWDFNKNREESDLHHAVDAAIVACTTPSDIAKVTAFYQRREQNKELAKKTEPQFPQPWPHFADELRARLSKHPKESIKALNLGNYDDQKLESLQPVFVSRMPKRSVTGAAHQETLRRYIGIDERSGKIQTVVKTKLSEIKLDASGHFPMYGKESDPRTYEAIRQRLLEHNNDPKKAFQEPLYKPKKNGEPGPIIRTVKIIDTKNQVIPLNDGKTVAYNSNIVRIDVFEKDGKYYCVPVYTMDIMKGVLPNKAIEPNKPYSEWKEMTEDYTFRFSLYPNDLIRIELPREKTVKTAAGEEINIKDMFVYYKTIDSANGGLELISHDNSFSLRGVGSRTLKRFEKYQVDVLGNIYKVRGEKRVGLASSAHSKTGETIRPLQSTRD

SEQ ID NO: 622 - protein, 1088 aa, Artificial Sequence
  Cas9
MPKEFDPLKPAKYRLALDIGSKSIGFAIIFLKEDVNKLLKPYAIVRSGVRIFGDGRTPAAPGQLGSSLAAERRVKRSIRRQYARKRKRLQRLLRNLKELGFFPDDSKLCKSFEDLNPYELRHKGLTKELKPHEFGRLLMHMAKNRGFQSNRKVDLLADNIDSQAKAETSAMKSAIATLQSRLNGEFETLGAYLYERFKKGETIKSSKTQKGQKAEYEFSISRRMVKQEFDRLWAAQEQFNPELFNEQAKNTLKDTIFFQRNLLPQKVGKCTFLPEHERASKALPSSQYFRIISELNKISFTDAEGLILPISLEQRNKLLKSLRIKQKLSFDRIRTELNLDSTVLINLEHASKDSIEGDKTGYLLSKKEYFGPAWRDLSLETQDAIVTALLTHENEAELVQKLVDDFNIAHDVAKALANARLESQYMRLSKEAIERLIPELEKGVDSQDGYKVPVKYHEATEAAGFGHHSALQENWADFPTLDLKQLHSDDNDKYTVAELPLPYYGKVITRQVAFGTGDVNDPVEKRFGKIANPTVHICLNQVRVLLDEIIAKYGYPYEVNIELARELKQNHEQRQRSIKQQAANKKENEEIRREIKQAYKVEKARIITDSEISRADIEKWRLWRRSKSKLCVYSGKKICETMILNNEVEVDHILPRSRTGDNSYQNKVLVLNKANRIKSNRTPWEAKELFEAQGWSYEDILNRMRALDKHQLFRFAENSMDIWDKNYRSFEARALNDTRYISRVVKDYLKVVCHKDRIVVSNGAHTALIRREFGLNDLLGKKGEKNRDDHRHHAIDACVIGALDRSMLRKLQIAMEVAEKQNSARNFVGLQEPWFNFSTQVRRSIGQIYVSHKPNHNYEGEIFEASIYGLRLISDKRTEKYVGIKRNPETGKTDKPKKSVVVISDPKTQNRYGLRHKFHSEGLPKKYYGLSSSSVFCLEIYRDEKGNWQAYTIPRYEAYRIVKRRGVNALYDNKRSNFEGRPLVMRLMRDDCIAFEKNGVKEVYRIQKINGLKKNITLTRHFDANVDDRYRRMLKAQKAEKAGEDFDSEDLCDDLVFSSFGASSLYSNKARKVTISPMGVLRDPGFKG

SEQ ID NO: 623 - protein, 1088 aa, Artificial Sequence
  Cas9
MKKLVLGLDIGVASVGWGIIDAENGDVLDAGVRLFSSRDASENESRRTSRRQSRRLSRRKKHRRERIKQLLLAHDMDVCDIVNENPYQLRVKGLNEKLEISEIYVALTHLAKRRGVSYLDDVVEEGGAIKSEHLNKNMEEIKSGKMPCEIQLERFEKYGQVRGMIEINQDTEESSFLVNIFRTSDYIKEAKTILATQQKFHKQITNEFIDEYINIMASKRDYFIGPGNEKSRTDYGVYRTNGDTWDNLFEILIGKCSVFPEETRAARSSYVAQEFNLLNDLNNLKISSLESGKLSTSQKHDIVEKVKNSKKFGTKDLLKYIASVCECKIENIDGCRKDKNRKPIMHTFENYRKVHNALNEAGVDLRLSEADYDELMKIMTLNSETLEIKKQCKEKLPHLTEDYLNVCLVLNKKGAFSGWHALSLKAMKLMMPELYGTSKNQMQIIHTMQLGKAYIKPLNQQKYLNSEAILEEIYNPIAARSIRQTIKVTNAILKKYGPLDSVIIEMPRDYQTSEDERKMIEKMQKENEKEKKAALKRAREEYPFPDEAFRNHKELATKLRLWYQQDQFCVYSGRKISVVDLVRNPNQFEIDHIIPQSVSLDDSLNNKVLCFSEENQKKGQQTPFYYHKGKSGNWTYEQYKLFVEKLFDKKKISNKKRELLLFEEDINKWDVRRGFIARNLVDTRYASRVILNSYQQYFGNHEMGTKVKVVRGKFTSQLRKKWKIFKDRNESHSHHAIDALIVAATANLRLWKKNKLGISDEGKVYDKETGEILPFEKLTASEYNEMMNKEPYLNFKTKLQNIETKVKYSYKVSKKVNRKISNDTIYSTRERDGIDYIVGKIKNIYDVKTYKDQFLKRYKKNKEQFLMYQHDPQTFAILESIMATYPDAENPFLAYKKEHGVIRKYAKNKAGAPVTSLKFIDGALGQKIDVTYKNKAALPKNKKVVLQSIKPYRADVYYDEGNKRYHLIGVKYSLFSFSKQGYVINPIAYQKLLEKEQIHSEMKFCFSLYREDIIESGEDPDSLTRYRFWSKNESGKNKIEVKPIEKPNFEDRKVITITKKIKILNKYQTDVLGNSFKAQEEKDPRSIE

SEQ ID NO: 624 - protein, 1088 aa, Artificial Sequence
  Cas9
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 625 - protein, 1089 aa, Artificial Sequence
  Cas9
MTAFKPNPLNYILGLDIGIASVGWAMVEIDDKENPVRLIDLGVRVFERAEMPKTGDSLAAARRLARSVRRLTRRRAHRLLRARRLLKHEGVLKPEDFDENGLVKPLPYIPKQPRNTPWQLRAAALDRKLTPLEWAAVLLHLVKHRGYLSQRKNEGETDDKELGALLKGVADNTHALQAGNFRTPAELALNKFEKESGHIRNQRGDYSHTFSRKDLQAELVLLFEKQKEFGNPYVSDDLKNGIENLLMTQRPALSGDAIQKMLGHCTFEPAEPKAAKNTYTAERFIWLTKLNNLRILNQGNERPLTDAERTTLMDEPYKKSKLTYAQARKLLDLDDTAFFKGLRYGKDNAESATLMEMKAYHAISRALEKEGLKDKKSPLSLSPELQDEIGTAFSLFKTDEEITGRLKGCLQPEILDALLKHISFDKFVQISLKALRRIVPLMEQGKRYDEACAEIYGDHHGRRNSEETLYLPPIPADEIRNPVVLRALSQARKVINGVGRRYGSPARIHIETAREVGKSFKDRKEIEKRQEENRKDREKAAAEFQEYFPNFVGEPKSKDILKLRLYRQQNCKCLYSGKEINLGRLNEKGYVEIDHALPFSRTWDDSFNNKVLVLGSENQNKGNRTPYEYLNGKDNSREWQEFKARVETSRFPHSKKQRILLQKFDEEGFKERNLNDTRYVNRFLCKFVADHMQLTGKGKRRVFASNGQITNLLRGFWGLRKVRAENDRHHALDAVVVACSTVAMQQRITRFVRYKEMNAFDGKTVDKETGEVLHQKTHFPQPWEFFAQEVMIRVFGKPDGKPELEEADTPEKLRALLAEKLSSRPEAVHEYVAPLFVSRAPNRKMSGQGHMETIKSPKRLDEGISVVRVPLTQLKLKDLEKMVNREREPKLYEALKARLEAHKDDPAKAFAEPFYKQDKAGNRTQQVKAVRIEQVQKTGVWVRNQNGIADNATMVRVDVFEKGGKYYLVPIYSWQVAKGILPDKAIIAFKDEEEWQLIDDSFNFKFPLHPNDLVEVITKKARIFGYFASCHRGTGNINIRIHDLDNKVGKNGILEGIGVKTALSFQKYQIDELGKEIRPCRLKKRPPVR

SEQ ID NO: 626 - protein, 1089 aa, Artificial Sequence
  Cas9
MNVRYKIGLDIGITSVGWAVVNLDIPRIEDLGVRIFDRAENPQTGESLALPRRLARSARRRLRRRKHRLERIRRLLIREGILMKEELDKLFEERHEIDVWQLRVEALDRKLNSDELARVLLHLAKRRGFKSNRKSEHNSRENSTMLKHIEENRAILSSYRTVAEMIVKDPKFALHKRNKGEHYTNTIARDDLEREIQLIFTKQREFGNMNCTKEFENEYIAIWASQRPFASKDDIEKKVGFCTFEPKEKRAPKATYTFQSFIAWEHINKLRLVSPAGTRGLTDEERRLLYEQAFQKNKITYHDIRTLLRLPDDTYFKGVVYDRNMPLKQNETIRFLELDAYHQIRKVIDKAYGKGKSSSFLPIDFDTFGYALTLFKDDADVRSYLQNEYEQNGKPMPNLANKTYDNELIEELLNLSFTKFGHLSLKALHNILPYMEQGEVYSSACERAGYKFTGPRKKQKTMLLPNIPSIANPVVMRALTQARKVVNAIIKKYGSPVSIHIELARDLSQTFDERRKTKREQDENRKKNETAIRQLMEYGLTLNPTGHDIVKFKLWSEQNGRCAYSLQPIEIERLLEPGYTEVDHVIPYSRSLDDSYTNKVLVLTKENREKGNRTPAEYLGVGTERWHQFETFVLTNKQFSKKKRDRLLRLHYDENEETEFKNRNLNDTRYISRFFANFIREHLKFAESDDKQKVYTVNGRITAHLRSRWEFNKNREESDLHHAVDAAIVACTTPSDIAKITAFYQRREQNKELAKKTEPHFPQPWPHFADELRARLSKHPKESIKALNLGNYDNEKLESLHPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPIIRTVKIIDTKNQVVPLNDGKTVAYNSNIVRVDVFEKDGKYYCVPVYTMDIMKGVLPNKAIEPNKPYSEWKEMTEDYTFQFSLYPNDLIRIELPREKAIRTSTGEEIKIKDFFAYYKTIHSGTGGMELISHDRSFSLSGVGSRTLKRFEKYQVDVLGNIYKVRGEKRVGLASSAHSKTGKTVRPLQSTRD

SEQ ID NO: 627 - protein, 1090 aa, Artificial Sequence
  Cas9
MRWRLGLDMGAGSLGWCAVGLDDQGYPDSILAAGSHIFGDGRAPSRGDQQGTPLGVERRAAKAMRRRRDRFLGRQAKLLARLTLAGLFPADPVRAKALELLDPYVLRARALDEALPPHQLGRAFFHLNQRRGFKSNRKTDRGVDDEAGKIAIGIDRLRAAIAAAEARTMGEFLHKRRQSAPDVNQIPSVRTRLRPETGEEAKGDGYDFYPGRELVEEEFDAIWDAQAPHHPSLLTPDNRALLHEAIFYQRPLKAPKIGKCTLLNNEPRLPKAHPLFQRRRLLEEVNALRIVRPGEVATKLTCEQRDLLMLKLKDKAKVSFETLRSKVLKLEPEARFNKEGENRTELVGDEVCAQMSAKTRFGKAWAHFTDEKRWAILSRLIEEEDEERLDTWLRTEHGLDAEQARAVAGARLPAGFGRFGETATRRLIAALQAEVIVYSEAVVAAGLGHHSDMRTGEVLAELPYYGMTLERHLLPGTGDKADPEELRIGRLTNPTVHIALNRLRRIVNRLIKTYGRPEQIAIELGRELKLTDEDKQRLSRQNNRNRADAEARSKKLAELGQADNGANRARLKLWEELNRENALDRRCIYSGQQISIAMLFSDAVEVDHILPFDATLDDSNNNRILCLREWNRRKRKQSPYEAWGHTDYWPDIAARAARLPKEKRWRFEPDAMQRFSAEDRFIARHLVDTQYMSRLAREYLEALYPEKGEGSGHVWVSPGRLTELIRRKLGLNELLPDHNFAGVKNRLDHRHHTIDAFVVAVTDRSLLQGISRASALEGEEGRERVIVPEPWDGFREALRTTLNTITVWHRQDHGTASKAGLAQGRDQTAGKLHNDTAYGLTGRQDTKGNDLVVSRKPLMSLKPADIEPVPDVAPITKGVRDRDLRKALAHFTQATEGKGFLQALERFTRLGPLHFRGIRRVRLIQPLAVIPIKGPGGVPYKGYLGGENFRCDVWEMPDGAWKPEVTSMFQAHQPGWTSAIRAACPTARKVLSLHKRDMIAIEREEGVRTLMVVAQIWSNGQVTLVEPHEAGDLNKRNKSEDDPFGYFMPTAGGLKRLKARQVRVDELGRVQDPGFPARKARRRTRPKQVD

SEQ ID NO: 628 - protein, 1090 aa, Artificial Sequence
  Cas9
MDWRLGLDLGANSLGWAALRLDRAGDPIGILAMGSRIFSDGRDPKSGASLAVDRRAARAMRRRRDRFKQRQAALLKYLIRDGLFPADQADRQRLADEDPYALRARALDEELSLFEIGRALFHLNQRRGFQSNRKADRGQDDEAGKIAVGVDRLNQQMEEQGARTLGEFLHQRRRAATDANHIPSVRTRLRPETGEGAKGDGYDFYPSRALIAEEFEEIWAAQAPHYPDTLTQQVHDRLYEIIFHQRPLRAPQVGQCTLVAGETRLPKAHPLFQKRRLLEEINALMIVRPGEIAQRLTPEERDTLYLKLKDKRTVSFATLRKTLKLDSAARFNKESENRTELKGDEVAAELGAKTRLGTRWQHLSGDQQWEVVHRLMALESQADEAAFRDWISQTYDLLPEQAAAVLGARLPQGHGRFGPTATTTLIDSLLHDRTEDGRVVVYSEAVQRSGLGHHSDLRHDRDDEDVTELPYYGVALERHIMPGTAEPTDPEEMRIGRLTNPTVHIGLNQLRHVVNRLIRAYGPPKEIAIELARELKLSEDEKKKRNSENRDNRLAAEGRSKKLEEIRQRDTGANRALLKLWEELNPGNVLDRRCIYTGEQISIDMLFSDRVEVDHILPFAQTLDDSNGNKLLCLREANREKRRRSPYEAWGHTDRWPDIAERASRLPKPKRWRFEPDAMQRFATEDGFLARHLVDTQYLGRLAREYLSWLYPGRGEGSGHVWVSPGRLTEMVRRKLGLNDLLPDHNFGGGADQPKNRLDHRHHAIDALVVAIVDRGMLQAIARASGQDGSEGRERIHIPAPWDGFRDDLRVAVNGIIVSHRPDHGTVAKAGLARGRDQTAGRLHNDTAYGLTGETDAKGNSIVVRRIPLSAIKKPADIARVRDPLLRNALAEFTKGLDGKAFEARIGRFHELGPLLYRGIRRVRVVETLTVIPIRDAEGRAYKGYKGDSNYRYDVWEMPDGKWRCQVVSMFDAHQSTEQARPHPAARKILSLQRNDILAIERTEGDRELVRVVKFSEKQFAVAPPHEGGSLKTRDGNADDPFRYLYPSPNTLKGWRARQVRIDELGRVLDPGFPARKSVRRTRPRAAPVD

SEQ ID NO: 629 - protein, 1091 aa, Artificial Sequence
  Cas9
MYSNLLFSFDIGTNSIGWCVFALDEAGEPYRIVDLGARIYADGRDPQSKTSLAVARREARAMSRRRDRYLRRRKATLRTMIEYGLMPGDKAGQEAVLRETGDREGGDESFNPYALRARALSEKLPPAYIGRVLFHLGQRRGFKSNRKTDRKDNDKGKIALGIDELTAAMHRSGSPTLGAWLAMRRAEGHSVRLRAGSEVFDAEGYAFYPERSLLEDEFRQIWDAQAVHHPDILTPERRAHLFRVMFYQRPLKKPLVGRCSFNPAEFRLSRAHPLFQEFRLYKEINDLEVVLPDQSHRKLTLDERNALVAKLKTSRKASFSALRKTLKLTPDLVFNKESEARKELLGDEIYSVLADAKMFGARWGGFSRARQWEIITRLKEEEDPASLSSWLKSEFGLDDERVTAIANASLPDGYGRLGETALASMLEELKTAVIPESEAARLCGYDHSNLAKEQDEGLDTLPEYQEILERHIPPGTGDPDDIYDLRKGRITNPTVHIGLNQLRRVVNALIHRFGRPQRIVVELARDLQLSEKQKDDVNRRIAKNTREAEGRSQKLIEMGQLDTGYNRLLLKLWEELNLDKPEDRVCIYSGKPIGIAMLFSGEVDVDHILPWSKTLDDSQANKLLCLKSANRQKRNRTPSDVPEWRDRYDEVLARAARLPRNKRWRFAADAMQQFEAEGGFLARQLTDTQYLSRMALEYLSALYPSEEADKSGELRQRKRVHVVPGRLTELLRRNWGLNTLLPDHNLGEMAQEKNRRDHRHHAIDAAVIGTTSRSLLQRMSGAAARLDDVAFDDLVRTVVKDNPPWPGFREELLAAIGRVTVSHKPDHGTVSRAAYAQGKGQTAGKLHNDTAYGLTGLVDAKGSPLVVRRKPFMALEVKDIASIRDTELQSALYGAIGSLTEKKALQEALIRFRDTHPQFKGIRRVRVLETLSVIPIVDRDGKAYKGYKGDANYRYEVWETLDGKWHTEVVSMFDAHQPGWQSPFHKQNPAARRVLKLQQNDMVAYEHPADGYTIARVVKFSNDKRIYFASHRESGSLKARDADKGDPFSYFAKANNGLRDIKCRQVRIDAAGRIFDPGPQDRETRQANKGV

SEQ ID NO: 630 - protein, 1092 aa, Artificial Sequence
  Cas9
MAYTMGIDVGIASCGWAIVDLERQRIIDIGVRTFEKAENPKNGEALAVPRREARSSRRRLRRKKHRIERLKYMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRASLLVEIHTLFESQRQHHNFLASKDFELEYINIWSSQRPVATKDQIEKMIGTCTFLPKEKRAPKASWHFQYFMLLQTINHIRITNAQGTRPLNKEEIEQVVNMALTKSKVSYHDIRKVLDLSEEYQFVGLDYGKEDEKKKVESKETIIKLDDYHKLNKIFNEVELAKGETWEAVDYDTVAYALTFFKDDEDIRDYLQNKYKDSKNRLVKNVANKEYTNELIEKVSTLSFRKVGHLSLKALRKIIPFLEQGMTYDKACQAAGFNFQGISKKKRSVVLPVIDQISNPVVNRALTQTRKVINALIKKYGSPETIHIETARELSKRFDERKNITKDYKENRDKNERAKKHLSELGIINPTGLDIVKYKLWCEQQGRCMYSNQPISFERLRESGYTEVDHIIPYSRSMNDSYNNRVLVMTRENREKSNQTPYEYMGNDTQRWDEFEQRVTTNPQIKKEKRQNLLLKGFTNRRELEMLERNLNDTRHITKYLSHFISTNLEFSPSDKKKKVVNTSGRITSHLRSRWGLEKNREQNDLHHAMDAVVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNAKKAFSTDLHKPKKDGTKGPLIKSVRIMENKTLVHPVNKGKGVVYNSSIVRTDVFQRKEKYYLLPVYVTDVTKGKLPNKVIAAKKGYDDWIEVDDSFTFLYSLYPNDLIFIRQNPKKKISLKKRIESHSISDSKEVQEILTYYKGVDSSTAAIEFITHDGSYYAKGVGVQNLDCFEKYQVDILGNYSKVKGEKRLELETSDNNHKGKDVNSIKSTSR

SEQ ID NO: 631 - protein, 1092 aa, Artificial Sequence
  Cas9
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 632 - protein, 1094 aa, Artificial Sequence
  Cas9
MKSTLAIASISSLGWVIELGENRIMRLGLDIGSTSIGWWIYETTDGQITSVIDGGVRIFSDGRDPKSKGSLAVDRRVARAQRRRRDRYLRRKAALMKRMAEVGLMPSDPKQAKQLEALDPYELRARGLDETLELTELGRALFHLNQRRGFKSNRKTDAGDNESGKIIDATARLDWAMRDHRARTYGEFLHMRRQKADTPRTTPAVRTRLTIAARDGAEKEESGYDFYPDRQHLRDEFDALWEAQAEYHGVLTEDLRDEIGTIIFHQRPLKTPKVGKCLFTNEERVASAHPLNQRRILVETVNALRVAQLGEVARALTLEERDTILHALDNKAHTKSLSGMSIKLKALGKVIKLRSGQYFTLETANRDAIACDPVRASLSKPDRIGSYWSTLDHNAQWEVVNRIRAVQSDADHRELVAWLVSQHRLAAEHAEGAAYAPLPDGYSRLGITATKRILAALEANVIPYSKAVESCGWHHSDERTGEVLDRLPYYGEILDRHVIPGTYDDSDDDITRFGRITNPTVHIGLNQLRRLVNRIIEVHGKPDEIVVELARDLKLSQDQKADVERTIKKNTQAAIRRGEKLEEMGVPNTGGNRMVLRLWEDLNDDDVMKRFCPYTGQRISAGMLFDGSCDVDHILPFSRTLDDGFTNKTLCLKEANRKKRNYAPHEAAEKGLLDRDAMDSVAKYLPDNKAWRFAPDAIERFEGERDFTARALKDTQYLSRLARTYLDALYDGGDDKSHVWVVPGRLTEMLRRHWGLNGLEALADSDEKTVKRKNRTDHRHHAIDAAVVAATDRSLIQKISKIAASDEQAGAEDTLKSTPPPWDSFRDDIAAQLQNITVSHRADHGRTDSLAKGRGEDTTSGALHEATALGIIDETHVTVRIPIESLKSGHLIEGSRNGYIRDPYLRDQLTLATKNGSDKDFTTVLQKFFDRSKRYGGTRRVRIIKTLQDTARISVPHNAPIKAYKGGSNHAFEIWRLPNGKIESQVITTWEHHNLTEPKRPHPAAKRIIRLHKTDMVAIERDGKTVICFVQKTDPSNGAFLVPHFEANADGRKRKNEPVEWYQMSANSLIKADLRRVGVDEMGRVRDPGPPPIR

SEQ ID NO: 633 - protein, 1094 aa, Artificial Sequence
  Cas9
MKYRVGFDLGTNSLGWAVVRLNASGEPDRIEVAGSRIFSDGREPKSGASLAGARRDARAMRRRRDRFKQRQAALIKYLTQAGFFPADESERKALSALDPYELRARALDEALPLAHLGRALFHLNQRRGFKSNRKTDRGKNDDTGKIRIGVARLYEQMRDADARTLGEFLHKRRAAASDPNAIPHVRTRIVTLAAEDGKASDVYDFYPDRQTLEEEFEAIWEAQTSHHPEALTEERRAQFYEIIFHQRPLKQPKIGFCTLLPPEKRLPKAHPLFQRRRLLEEVNALRIVLPGKETRALEKAERDALLSKLNQRKKAAYESLRKALKLDPDARFNKESDNREDMIGDEIAAEMAHKSRFGKVWLGMSAEAQAQVIERLRGLESDADADDFEAWLRDDHGLAQEQAKAVTAANLPEGYGRFGETATRKLIAALEQEVIVYSEAVQRAGLGHHSDLRDGQVWTDKKGNPALPYYGAVLERHIVPGTADPNETDDALRIGRLTNPTVHIGLNQLRRVVNALMRRYGQPQEIAIELARELKLSDDRKKEINTRNRENRKAAEKRSQKLRNIGQADKGGNRALLKLWEELNPENVLDRRCVYTGRVISIDMLFSGAAEVDHILPFSVSLDDSNGNRILCLREVNRIKRQRTPWEARDDLRAHFGPDAGWEAIAARAARLPREKRWRFEPDAANRFDAQGGFLARHLTDTQHLSRLARSYLSALYPETGEGSGHVWVSPGRLTEMLRRAWSLNHHLPDHNIAGAANQPKNRKDHRHHAIDAIVVALADRAMLNRIARESGKEGHEAAGRLVASIPEPWEGFSDEVGRAVRAITVSHRPDHGTASKAGRAKDKDATAGRLHNETAYGLTGEKDARGLDIVVTRKPLSAFKKSADLDAIRDDDLKQKLKAWAAGKEGGAFEQAMRSFGDPERGPRSHPGLRRIRVTEPLSVIPIRDRDGRPYKAYKGDSNYRFDIWELKTGKWKDEVVSMFEAHRPNWTSPIRAGNPTARKVLSVRQNDVIAIERENGPELMRVVKFSAGSLALAPPQEAGSLKARDADKNDPFKYVYGSPSSLQRWKARQVRIDELGRVFDPGFAVRSRRSSE

SEQ ID NO: 634 - protein, 1096 aa, Artificial Sequence
  Cas9
MKNIFSFDIGTNSIGWAVLALDGNGDPVRIADAGVRIFSDGRDPKSKASLAEARRMARAMSRRRDRTLRRKRATLRTLAEIGLMPDTSSARQAQLRETSDPKSGSGQLTRNPYALRALALEEKLPLFHIGRALYHLGQRRGFQSNRKTDRKDNDKGKIALGIEELHAAMRQDGAQTYGQWLARRHALGQAVRLRSGALDLEGEGYAFYPERKLLEDEFHRIWEAQARHYPDILTPERRDHLFTVMFFQRPLKKPKVGKCSFNNQEERLSKAHPLFQEFRLYKEVNELEIVEPDLTHKKLTLDQRNALVKKLQVSREASFAALRKVLKLRPDQRLNKESESRTKLKGNEVYAVLSDKTRFGPRWGTFSQAEQWAIIERLKEEEDPGRLFAWLRSAFGIEGEQAADIANVHLPEGHGRLGKTALEAMLEELKAEVITEAEAAKRCGYDHARLGGGSDEGEPELPPYQEILQHRIPPGTNNPDDPYDIEKGRFTNPTVHIALNQLRHVMNTLIRRYGKPAQIAVELARDLKLSERQKEEVNRTIARNTRDAERRGKTLEENRIPNTGYNRTLLRLWEELNPGKVEDRCCIYTGKPISISMLFSGEVDIDHILPWSRTLDDSHGNKLLCLREANRVKRNRAPADVTEWRDNYDEILSRAARLPQNKRDRFAPDAMERFEKAGGFLARQLTDTQYLSRMALEYLACLFPAEEMDGFGELRRHRYINVCPGRLTEMLRRNWGLNSILSDSQLGETAQEKNRKDHRHHAIDAIVIGVTGRSLLNRISYAAGRLEAQQLETLVKEAAATNKPWDGFREDVAKVVGGIIVSHKPDHGTAGRKAKDPARQQTAGRLHNDTAYGLTGETDARGNTIVVRRKPFLSLTSKDIPSIRDEALRAVLEQHLRGIPDGKAFQAALDAFRKQKGFHHYHGIRHVRLTEPLSVIGIKDRDGKVYKGYKGDANQRYDVWETLDGKWHAEVVSMFDAHQPGWQSRFHAENPTARRVLRLQQDDMVALNAPDGGRLLVRVVKFRQNGQITFAGHNESGNLKARDAASNEQDPFKYISRMASSLKDCGCRQVRIDATGQVFDPGPQDRASRLQKQSKR

SEQ ID NO: 635 - protein, 1097 aa, Artificial Sequence
  Cas9
MKKQPQRYILGLDLGIASVGWALILVDGAENPVGLLDCGVRTFERAEVPKTGDSLALARRQARSVRRLIRRRAHRLLRLRRLLKREGILSAADFNSDGLPNLPIDAWQLRVAGLERKLTNQEWAAVLLHLVKHRGYLSQRKSETQTENKELGRLLAGVAENSKLLSESSEQYRTPAELAVKLFAEQSGHLRNKGGEYTHTFNRLDLQKELHLLFERQYALGNPFASAELQSKVDELLMTQRSALQGEAVLKMLGKCTFEPSEYKAAKNTYSAERFIWLTKLNNLRILYNGEERALDEGDRKKLLDEPYKKAKLTYKQVRSILNLPESAVFKGLRYGKDSDGLKAENGTLMEMKAYHKIRTILDKAGLKGEWENRIRNPEILDKIGTAFSLYKTDEDIQAALADLRLPENVLDALLAGLNFDKFIQLSLKALRNILPLMERGIRYDEACKEVYGDHRALAESKNQVLLPPIPADEIRNPVVLRTLTQARKVINAIIRRYGSPQRVHIETARELGKSKQERDKIDRKNKENQNDRNRLASDIRKHFNFEPTPKDILKLRLYEQQHGKCLYSDLREEKGECLYTGNVIELHRLFEDGYVEIDHALPLSRTWDNSLNNKVLVLKSSNQNKGNKTPYEWLDGANNSRRWREFQARVQGCHFPYVKKQRIQTAKLDSKAEQGFLERNLNDTRYISKFMCQFITANLRLAETSNALMEEVAGENPYWKERKRQRVFAPSGSIIALLRGLWGLKKVREDNDRHHALDAIVVACSTVSMQQKITKAMQRRETLETVDSETGEVKTRIPQPWDFFRQEVMIRVFSDSPREELAEKLNSRPEALHDFVSPLFVSRAPNRKMTGQGHLETVKSAKRLSENISVVRKPLTALKLKDIENIVGYPDREPALYQALRERLLAHKDDPVKAFADKPFYKPAKDGGQGSLVKAVRIIENTKHGLKIRNGITDTNGDMVRTDVYQKTDKKGKRQYFIVPVYAWQVEKNELPTVDCKGYEIDDNYEFCFSLYKYDLIEIQNPNDINQELRAYYINCDSSDGRFWLAYHDKSAKEQQFRISTQNQPIIKKYQVDTLGKEIRLCKAEKRTALNGKKKK

SEQ ID NO: 636 - protein, 1097 aa, Artificial Sequence
  Cas9
MGKGDILFSFDIGTNSIGWCVFALSDNGDPCRILDANARIFADGREPKSGNSLAEGRRAARAMARRRDRYKRRRKAVLRTLTEYGLMPADPKARQALVAKTGDRGPKSEEALADVYSLRARALMEKLPLHHIGRALFHLNQRRGFKSNRKTDRKSNEKGAIETGVNRLLEEMRDTGAPTLGAYLAKRRSDGRPVRVRAGASEQEAEDGKPAKTAYDFYPVRRLLEEEFDAIWEKQYSYHPEVLTEERRGHLFRVMFHQRPLKPAIVGRCSFNSAETRLAKAHPLFQEFRLYKEVNELEVVMPDQSHRKLTLPERDRLVLKLRGQRKATYAALRKELRLRDLRFNKETENRTDMMGDEVTAALADKAVFGNRWSGFSTDEKWRIVERLREEEDPFALHEWLVSEHGLSDAEAEQAAKVHLPDGYGRLGPTAVSTMLEELKADVITEADAARLAGYDHSLARADEDGLDRLPKYQEVLERRIPPGTNDPDDPYDIAKGRITNPTVHIALNQFRHVVNALARRFGKPDQIAIELARELKLNDRQKDEVNRVIGRNTRAAALRSQKLRDIGQKDNGYNRALLKLWEELNPDKPEDRVCVYTGRPICISMLFSGEVDVDHILPWSRTMDDSQANRILCVVEANRVKANRAPAEVAEWGGRYDEILERAARLPRNKRWRFARDAMEKYKENEGFLARQLTDTQYLSRLAREYAEALYPTEEPDRLGELRRRNHVRVIPGRLTEMLRRGWGLNALLPDHNFGAGQAKNRKDHRHHAIDAAVVGVTTRGLLQRISTEAGLREKLALEETIADIPMPWPGFREELKAAIDRAVVSHKPDHGTLPKPGEHGRTAGQLHNDTAYGITGETDARGNPIVVRRKPFLSLTDKDIPSIRDTELRGRVYSATSGLSGRELSAALDYFRKTDKQFRGIRHVRVTESLSVIPIRDRDGNIYKGYKGDANFRYDVWELPDGKWKADVVTMFDAHRPDRAAEERRPHPAARKVLSLKQNDMVACEHPKDGYTIGRVVKFNTAGQIYFAAHNEGGSLKARDADRADPFKYFSKSASGLKEIAARQVRIDATGQVLDPGPQDRESRLARNKRLERERA

SEQ ID NO: 637 - protein, 1100 aa, Artificial Sequence
  Cas9
MKYTIGLDIGTSSVGWGVIDTERNRIQDLGVRLFESAENQKDGESLAKPRRDARSMRRRLARRGSRLERVKSIFEKAKFLTRGQMGITHARPNDPYRLRAEGLDRLLSNEDLFIAVYHLAKRRGYKSNRKNVLEGDGEDVREGKAVLDGVAQNKKLMAFRGYRTVGEMFFKDSVFTEAKRNKAGSYKHCVLREMLEDELGKILHAQRSLGNTLVTDSFISKLLEKKTGVFVYQRPFASGNQILKLVGPCTFEPEEIRAAKATYSFQYFNVLQRLNNLTIKNTDTGTERKLTSEERAKMIAFIFSHKDVQYAQIRLELKLSDVDRFNMVNYFVQRKELETKTAEELRREIEKKTKFPSLSDYYTIRKTVSEIDSAFWIQIEKQHDVIDAIGEIFTLYKTDEDIIAQLNTRIPSIPRPVVSALLGLSFTKFGHLSLKALRKIIPHLENGDTYDVACAKADPKYTDRAKTRARKLRPLDKEDHSITNPVARRAIAQTIKVVNAIIDKYDSPSEVHIELGRDLAKNFKERMKIQKEQKQNQEGNERAIAKIHELYKLENPRGQDIIKFRLWNEQNGQCMYSGERIDEIRLFDNGYTEIDHIIPFSRSFNDSYSNKVLVLKMRNQEKMNKTPYEYMGGDADTWQRFENLVNSMHNIGPRKKQNLLLKKYVADDLTLRTLNDTRFIARYMKNYIENTLLFTEGPQKQRVYTVNGQATAYLRKRWVLHKDRTENNRHHAQDAVVVAVATPSLVQGIMRHAKMGEIVDYLHSQKFAPNVTDIETGKPFESADIQSAKERIIAKHEHRLRIPEPWEGFSDELDARMGDDVVEKLSLRKSNIHGYKTTSDFSQIHPIFVSRMPKRKTTGRAHQETLRSPRRFKEFQESVVRTPLSSINLKKLEEMSGKNSDKLLYDILRKRLLAHGDDPKKAFTEPVHKPRKDGTQGPLVRSIKMVSEGQRSGILVNNEQALVDQDSMIRIDIFSKPNKKGKDEYYIIPVYAYHFAQKELPNKVITAKAEADWRTIDDTFAFEFSLYPNDLVKLTKGDDIRFGYYSGCNRALAAIHILPHDQNMPLVNNGIKTLDKIDKYVVDILGEYHKVGKETRQQIQ

SEQ ID NO: 638 - protein, 1100 aa, Artificial Sequence
  Cas9
MGATIVTDISRSAFAFDIGTKSIGSAVLRLDDRGEPIGIINAAVRIYADGREPKSGTSLAEGRRLARGMSRRRDRYKRRRRTLLNTLTEFGLMPPTDEARKALLAETNDRRFGAVAGNVYALRARALDEKLPLHHLGRALFHLNQRRGFKSNRKTDKRDNDQGKIASGISRLGQKLDEAGARTLGEFLHRQHSAGKWVRVRPSRVPSKDDKEEDGYGFYPERSFLEREFAAIWKAQAAFYPELLTEERGDHLHRVMFFQRPLKRPKVGKCSFYPDEDRLPKAHPLFQEFRLVKELNELEVVHRGDRREKLTLEQRDTLFNQLRTQRSSAFTALRKTLKAPTGTRFNKESDARDKLKGDEVAAEMSHKDRFGQAWIGMPLAERWAVIEMLLDTEDPLEVKAWLEEHYGFAADRIDAIAAAKLPPGYGRLGETALRDMLDELKNGTVKDDSGRDVVLTERQAMDNIWKDNPALQRVVADARELPPYQEVLGRRIPPGTGKPEDPYDVQKGRLTNPTVHIGLNQLKRVVNALVRRHGRPDQIALELARELKLNEEQKAEKDREIARNTKAAQARSEKLRQLDIDDNGYNRVLLKLWEDLNLRQPENRECIYCGKAIGIGTLFSNQVDIDHILPWSKTLDDSQANRIVCHVECNRQKGNHAPAEVPQWHDRYDDILARAERLPRNKAWRFGREAMKKFKDDESFLARQLTDTQYLSRMAHEYVAALYPDEEPDEWGVFTRRNHVRVIPGRMTEMLRRQWGLNAIISDHDQKNRNDHRHHAIDAIVVGVTTRRLLQRIATAAGGREALALEETIGKIEPPWPGFYDDVKEAIDRIVVSHKPDHGSLPKPGEPARTAGQLHNDTAYGFTGEERKGVPIMVHRVPFATLTEKDIPSIRDRQLAEALYGAIAGISGKAELAAALARFSASGPYKGIRHVRVVEPVSVIAIKDRDGTPYKGYKGDANYRYDVWELPNGKWTHEVVSMFDAHRPDWQSEIRNKNPAARKVLSLHQNDMVAYEHPQDGYTIGRVVKFGSGGQMALAGNREGGALKSRDADPEDRFRYFYKSGGAMRDARLRQVRVDETGRVFDPGPQDRESRNARKQSAAG

SEQ ID NO: 639 - protein, 1101 aa, Artificial Sequence
  Cas9
MKTLGLDLGTNSLGWAIVETRDEPTKYSEGSIVASGVRIFSQSEMAGRDPQSKASLAVARRQARGSRRRRDRYLKRRQRLVDLLVDLGLMPADKAARAELVKNHGDGKTGDLSSSVYALRARALDEALSPYEIGRAIFHLNQRRGFKSNRKADSNDPEQGVISEGMRALDEKMAEAGARTIGEWLHMRRLQGLPVRARIAPDGEGYAFYPSRGALEREFDRIMARQTLFHTDLLTDTAIRELREVVFHQRPLRPVKPGKCSYNPLEERLAKAHPLFQKFRLLKELNELEIVGEDQKHIKLTPEQRNALALQLRTSLTKQGKVPFSKLRSTLKLGREVRFNKETDNRSDLEGDVIYFRMSRPECFGNRWADLPVEMQAAITERLRTEPDYKTLMNWLKAETGLDEVHARAVADTPVPDGFGRLGQSALTALIDALENEVGEGGFVITEAEAAKRVYGRTNSEADPDRKGVDELPKYQEVLARHIPPGTGEPDDPYDDFMGRITNPTVHIALNQLRRVVNALIRTYGKPDRIAIEVGRDLKMNDRERDEVNRRIGRNTKAAIERGVKLTETFRQLDTGYNRLRLELWEDLNQKPENRVCIYCGKAIAGHMLFNGETDIDHILPYSKTLDDSKANRILCCTSCNREKKNRPPSRVPQWRSRYGEILARATTLPKNKQWRFAEDAMTRFGEEEGFLARQLTDMQYISRLALTYLAHLYDYEEVDLDGIYKRHARVRALPGRMTEMLRRQWGLNELLHDHNLIGGDVAKPKNRLDHRHHAIDAIVIACTSRALIQRLATASAAAEERGAERVVERIDPPWSGFREDVRAAVGAIVVSHKPDHGTVGREGYAKGRGQTAGKLHNDTAYGHTGEKDASGNDIVVRRIAVTDIRSPADIRKIRTNAHGHSELRDRLYEATRGLEGKAFEQAVLDFVKGDAKFRGIRHVRITEVANPVWITHGDGRHKKGYLPGGNDRFDVWELADGRWDAEVVTTFDAHRPGFVPRMRLENHNARKIMSLKKGDMIAYNDPVSGQRIIAIVRKFDQRNKQLYLDPHNEAGNLDRREKEKTYKPLRPMPNPLKKYRPRQVRIDEIGQVFDPGPWWERQDG

SEQ ID NO: 640 - protein, 1101 aa, Artificial Sequence
  Cas9
MEQTSLDLSQAMKKVAQPQKPYRLGVDVGVASIGAAAVTDTEILGIHVRTFEKGEINGKSGRKPLNADYRRQKGQRKRLRRKKNRLLSLRRLFRRVGMIESAAIEAFPISSTSPWQLRTEGLDRRLTNEEWAQVLYHIAKHRGFQSNRRVDMDEATKLSDAAGDSPETTTNTESDSDTKKMLAGVADNKRLLAEKGYRTIGEAVARDPKFSHRIRNKEESYSHTIGRDEINAELNCLFQAQNHYGNPHATEELSEQIIDLINWRRKTVTGDDIKRMVGRCTLEPKEYRAAIHSVSAEEFRWLSTLSRLRIVTQGESRPLTKCEWDKVVDLPWRQEAITYTSIRNAIGLRHDIRSRFNIRYETGGKKTKTDTKNETTKGQSADAVTSEVKTAEKETAFKAKGYHILRKAYKAFGYDEQWDRDRFNTELLDTLATAVTFYKDDSEIQAHLETNDTPEYAIQIALRLPTLTKFSKLSNKAILKILPHMRERQSYSNACLLAGYKNHHKQYDDTPQNGKIPRSAIEHIKNTVVYRSLNQARRVINAMVKEYGAPQEVHIELARDMEKSAKKKDEIDLWMKKRKKKNDELRERFGKNLSRDELLKYKLYEEQNGQCAYSLQPIQLGRLLEPNYVEVDHALPRSRSMDNSYNNKVLVLTKQNRDKGDRTPFEYFGEDQESVDWKRFTNWVESNPQMPQAKRRKLLTKSLQKGILDNFSARNLSDTRYIARELKTLIEHYILNTPEREKTKYERCVVISGKLTAQMRQLWGISKARDVSDRHHGSDAAVIACITPSMVRRITRYLQLQERRAMPSAPGKGDEHPAVVARAIPHAPVPWPTFEHDLEAALEKVLVSRPQSRKWSGPIHADTIYGEHKDQETNTVAPTQRIKLTQLTKSNYKNIVGYDEERNKDFIDQIEERLECHNFNGKQAFGTSQSPIYRIKKNGELGPEVKKVTIKLPIKNSVFRIRRGYVKNAKNSTIYINIYQNTKTGKFEMHPVYAKDLTSSANASKSFEYSPDLQLVDTIRRGDYIEITRRNGEVISGYYATHNISTSVLELQPHDTTDSRNNRTPAIKTSLNIERFHIDILGRKRRVVRRAKNGLADDRDK

SEQ ID NO: 641 - protein, 1102 aa, Artificial Sequence
  Cas9
MGYRIGLDIGITSVGYAILKTDEKGSPYKIEHLTSVIFPIAENPKDGKSLAMPRREQRGARRRNRRTKFRKHRTKMLFVRSELLTIKQIEAIYSEKQKLSSIYELRTKALNERLTNEELFRILYFFSGHRGFKSNRKSELTEKDMGPVLTAIKDIEEKLADGTYRTLGEYMELDEKYQEHKRNKDGIDRYLGTAKRSLIEDEIKQIIIAQQQFGNTKLTSGFQVAFIGDEEQTGIFNDQREFEDGPGKQSPYAGNQIEKMIGACTFEENEKRAPKASYTFQYFDFLCKLNNLKYRETIGGEYRFLSLEQKNVLKEKVLTTQKITFSGVKKLLDLPEHAQFNLVNYGTKSTVKETETKSVFYAMISYHKLKKAIPAPIFSNLSTAELDEIGRILTLYSSDKGRKNEFYSRLAIPEEVVEALLPINFSKFGNLSLKAMRKIIPYLEMGLVYSEAATQAGYDFRHKKIDQAYIHENVTNPVVKRAASQTIKIVNNIIRKYGEPDGINIELARELSKNFSERKKTVKYQEENRARNERIADKLRECELPVNGANITRLKLFEEQGEFDPYTGLKIPFDRAFSEEYEVDHIIPYSKTLDDSYGNKILVSAKANQEKGNRIPMEYLQGKPERIKKLESITATIKNPKKREKLLKQQLTKEDVDGWKTRNLNDTRYISSLLHDYFNQNISFAKLESEKKKRVIAVNGAITSKLRARWGFNKIRENGDEHHALDALIVACVTDKYIKEITSFSKRKEVRFNENLWKREKTPQEIEQEVVHFKKDYDRIFNQAFPLPWTNFREEVSCRMSENPAELMKNHTWETYTDDEIAALRPIFIVRMPNMKTSGPAHQETIRSGKLEEKGLNISRVSIEKLKLDKEGTIKSGNAQFYKDSGNGWQLLHDKLKVALEKHDGDGSKAFPDGVFKYQYLDKEHTVRKVRLVAKSTLQTSLNEKKSVADNGSMIRIDVFRNEQGKYQFVPIYAKDRVAKKLPNQAVAVGKIAKEWPLIEESDFKFSLYSNDLIRVKHKKGVKHVSKDGNKEEKSKTDFFGYYTGADIATASISGISPNNFFEFRSMGLATLISIEKYKVDYFGNYHQVNEKVRQKFPKNRM

SEQ ID NO: 642 - protein, 1103 aa, Artificial Sequence
  Cas9
MKYDIGIDIGVASVGEAVIDQEGNILEACSNLFDEADAASNVDRRNFREGRRNKRRERTRVNDFKKLWTKFGFEIPKNVMNDTILLRNKGIKCELDLTELYSVLLYMLKHRGISYLEDAIDEAKGSNYAKGIALNQKELKEKLPCEIQLERLKIYGSYRGDCIVKKEDEDEYHSNVFTISAYKKELEILFRNQKLPEEFIQGYMKIFERKREYYIGPGNEKSRTDYGVYTTNKDEEGHYITDKNIFEKLIGKCSVYKDEFRAAGASYTAQEFNVLNDLNNLTVNNRKLTENEKKKIVEKIKSSNAVNMRSIIKKVLGEDIEQFGGARKDKADKEIYHTFEVYRKMKKEFEKNGIDIADFSREKLDEIGNILTLNTETEGIKGALHEAKNSFTYSEIETLIDIRKKNSSLFSKWQSLSLKIMNELIPQMYAQPKEQMQLLTEMGVFKFKSVKFKNSKYIPVEEIIKDIYNPVVVRSVRTTIKMINETIRKYGYPDNIIIEMPRDKNSTEEKERIKKEQSKNEKEYEGILKRIKDEYDIEINRDDYRKQEKLALKLKLWNEQEGRCPYSGKMISIYGLLEDPQLFEIDHIIPKSISFDDSRNNKVLVYRSENQKKGNNTPYMYLSKGDKNWNYDQYKSYVLGLKNKGNISDKKVNNMLFMEDINKIDVLKGFITRNLNDTRYASRVVLNMLQSFFNEKDGCPTKVKVIRGSFTHQMRVNLRINKDRDESYSHHAVDAMLIVYSQRGYEAYRKIQEACVDFETGEIIDEERWQQCIWGKDYDQVMYEAKWSKIREKIIEAEKNVKYHHRVDKKVNRGLCNQTIYGTRIKDGKIYKISSYNIYDNKECASLLKMIKGGKESKILMYNYDSKTYRDMIKIIDEYSDEKNPFVAYMKETGDYFRKYAKKHNGPKIEKVKYYKEEAGSCIDISHKYGYEKGSKKVILGSLNPYRTDVFFNERLKKYYLIGIKYNHIKCEGNNYVIDEDAYNGLLRDAGVISHENTINDLEKVGVKYLFSLYKNDIIKYEKNGEMFVERFLSRTMEYANNYIETKPIHKPFFQKKDKKGNIKNSQNLVGLSKTKYIGKLVTDALGNTYMVEKEKFSLIVDI

SEQ ID NO: 643 - protein, 1104 aa, Artificial Sequence
  Cas9
MKLILALDIGIASVGWAVLDKKSETVLEAGSNIFPEASAAGNQVRREMRQARRIKRRQRTRLDDFNKLWRKNNLSIPQYKSTEIVNLKVKALREEISLDELYLILYSYLKHRGISYLEDAQDDSLSSSNAYTNGLRENAKALEKHYPCEIQRDRLQTIGKYRGQTQITDDNNEKIDLSNVFTIGAYRKEIKKVLETQKLYHNELTDELCDDYILIFNRKRKYYEGPGNEKSRTDYGRFTTRLDQNGNYIDEENIFEKLIGKCSVYPDELRGAAASYTAQEFNLLNDLNNLTINGRKLEESEKHAIVQRIKTSNTVNMRKIIADCMGETIENFSGARIDKSGKEQFHKFETYNKMRKSLSEIGTDIDEFSRDELDKIGYIMTINTDKEALMEAFNESGLNLDDSVKECLISFRKANSSSFSKWQSFSLKIMNELIPEMYIQPKEQMTLLTEMGVAKGSSGDFAGLNYIPVDVISDEIYNPVVRRSVRISFKILNAVLKKYKVLDTIVIEMPRDRNSDEERKRITDSQKLNEKEMEFIEGKLAQIYNIKLSSSDFSSQKQLSLKLKLWNEQDGICLYSGRTIDPEDIIKNPDLFEIDHIIPRSISFDDSRSNKVLVYRSENQKKGNQTPYFYITHSDGAWTYEQFKANVMNLSKKKEYAISRKKVQNLLYSEDITKRDVLKGFINRNINDTGYASRVVLNTVQNFFKAKEADTKVKVIKGSYTHQMRSNMKLDKNRDESYSHHAVDAMLMGFSEMGYEAYRRLQGEFIDFETGEILKNDMWNEKMSDDVYVDYLYGRKWSAIRNEIVKAEKDVKFWHFIVRKSNQGLCNQTIRGTREYDGKKYKINKFDIRTKEGVKLFKKLAFSEKESDREKLLVYLNDRQTFNNLVKIFEDYKDAPNPFVQYEKETGDVVRKYSKRHNGPRIDKLKYKDGEVGACIDISHKYGLEKDSRKVILESLVPYRMDVYYKESDKMYYLVGVKQSDIKSQNGANVIDEDLYTRILINEKMIEPGQSRDDLEQLGYEFRFSFYKNDIIEYEKEGKVFVERFVSRTMPKVRNYIETKPINKANFEKQNPVGLGKTKSIKKYRTDILGNRYLCEKEKFTKFC

SEQ ID NO: 644 - protein, 1104 aa, Artificial Sequence
  Cas9
MNHYVLGLDIGITSVGYGVIDLDNYQFVDYGVRLFKEGTAEDNVNRRTKRGSRRLKRRRQTRLDDMKELLQKEKIMSETYHSSYDPYDMRIKGLSQKLSNDELTCAILHITKCRGTTLEALDSADEDSEGTKSILSKNDQDLKKYHYVCLVQKERLKQSGKIRGTENNFKTDDYIKELDEILSHQDLSEDLCEKIRTIVSRRRQYYEGPGSEKSPTPYGRWIAQGVAPIDLIEKMRGKCSVFPDQLRAAKNSYTAELFNLLNDLNNLECEGEKLTTSQKQDVIDFVNEKGGITPKQLAKLLNVDLNQIKGFRIDKNDKPLLTEFKGYKAFKKIFDTNNCDLYKKDLSILDGLAEIVTGKKGIEERKQAIQQAYPEIDEAIVEQCAVMKGMTQYHSLSLKAMHLINQEMLQSPRNQMQVLHESHVFDKNRVSHKGQKYIEADDEAILSPVVKRAQRETFKVVNALREKYGEFESIVVETTRDRNSQEQKKRLNDSQKYYEQENRKVDELLSHEGYDPSKINGKTKLKVRLYLQQEGKTAYTNAPIDLNLLIKDATAYEVDHIIPLSISLDDSINNKALINRTENQNKSNMTPIYAILRGKLNISLDTYKTVVKNNRNYTGKKRSYLLYDKDITKFSNMQEFIARNLVDTSYACRVVMSTLSDYFKDNEISTHVHTVRGRVTNMFRNRINMQKEREKDYLHHAVDALIVASIKKLNLLNTYLLKYNFNDLYNEETGEVFAVGDDQQVLDPKYIRFITQLKTIYDESNMYYNGLIERNVMQFPPIKISHKIDTKPNRQISDETIYSTRTVGNEEYVVKKYSDIYDPKFTQLTDDIINDRPLDRWLMYRNDNQTFKIIQSIILDHFHIFKDDEKHYSCTKKKGQIQYALKGKNPLYLYKQEHGKVRKYAKKGNGPEITMMKYFDGKLGNNIDISNHYHVHNKKVVLLQISPYRTDFYVSPEGKYKMLTVRYANVFYKESKKKYVIDEKWYASEKKRKNITDDDIFVCSLHHDELIGIQKKDGAKYVYDLSTEDGGKPRLYHGEMEILKFTATNNDSKNIIEVKPIYTYCKKQLMISIGPITKLAKYATDVLGNVYEVKKNIIDHLSHL

SEQ ID NO: 645 - protein, 1105 aa, Artificial Sequence
  Cas9
MGIRIGLDIGIASVGWAVVDDDYNIIESGANIFNEAKAASNVDRRTFRQTKRLLRRQKTRLRDFDILWINAGLDIPKEKVNKQLQFRVQGMTMELSENELYAALKNMLKHRGISYLEDALDEEQSGKSTYEKGLQVNQKALKCDKMPCEIQYERLMKYGSYRGHIEVKDESGEEMILSNIFTLDAYCKEAKKILECQKQYHSFITEAFEDDYLALLRRKRKYYEGPGNEQSRTDYGKYTTKLNPETGEYVTEENIFEKLIGKCSVYPKEMRASAASYTAQIYNMLNDLNNLTINGRKLEYEEKKSIVEEVQKASSVNMLKIIKKVINEDITTIEGARKDKNDKEIFHKMETYNKMRHYFEKNGLEFKKISTDDLDEIGNILTLNTEKEAILEAFNKSQLELSQEEKEAFIEIRKKNGSLFNKWHSFSLKIMKELIPELYLQSKNQMQLLTDMGVFKKKTEIFQNYDKIPTDVIIEDIYNPVVKRSIRITVKIVNALIKKYGYPREVVIEMPRDRNSDEEKKRIQDEQKKNDTELKKIIEKVESEYGIKITDTHFRNHKNLRMKLRLWHEQDGRCLYSGKVIDISELLNDCSKFEIDHVIPKSISFDDSRSNKVLVYSTENQKKTNQTPYQYLEGNGKEWSFDEYMNQVIELKDRKLISKAKMNKLLFREDITKIEVLKGFIARNINDTRYASRVVLNSFQKYFESKQSDTKVKVIRGSFTHQMRKKLQLSKNRDESYAHHAVDAMLICYSQMGYEAYRQLQEDLIDPDSEKIRDLGLWKETITEAKYDEVLYTAKWLENRGKIQEAEKKVKFWHKVDSKANRALCNQTIRGTRVIDGSIQKINKINIYSVDGYKTFKNMIQKGKEKDFLMYRNDRRSWDDLMKVYREYSDAKNAFAAYQEETGDYVRKYAKKHNGSKITNLKYCAKELGSCIDISHKYGLEKDSRKVILESLSPYRSDVYYNAGLKQYYIVGIKNSDLCFLKGEYFIDSKRYLQILREEGVLTEQHTLNDLAAIGTEFQFSLYENDYLEYEKNGEIKTERFLSRTKPKQKNYIETKSIDAPKIKNKKQNLVGLAKSKSIKKIRVDILGNRYYASKEKFSLMVDKF

SEQ ID NO: 646 - protein, 1105 aa, Artificial Sequence
  Cas9
MDMAWRLGLDLGTNSLGWAALSLDAAGAPDAILAAGSRIFGDGRDPQSGTSLAVDRRAARAARRRRDRFKQRQRALLKHLEADGLFPADPEVQQALAALDPYALRARALDEALSLHEIGRALFHLNQRRGFQSNRKADRGKDEDAGKIAIGVDRLKDAIAAAGARTFGEFLRQRRAGATGENQIPSVRTRLRAETGEGAKGSGYDFYPSRALLKDEFDAIWHAQAEHHPKVLTDEAYHRLHEIVFRQRPLRAPKVGACTLVPGEARLPKAHPLFQRRRLLEELNALMIVRAGAVAERLTPEQRDLLLLKLKDKGKVTFKSLREKVLKLDGDARFNKESEHRTELKGDEVAAEMGGKTRFGSLWPHLSTEQQWTVIERQQALESDADEAAFRTWLVETHKLTAEQARAVAGARLPAGHGRFGLTATAALLAALRDGRTPEGRGPNAPATEAGRVVVYSEAAAIAGYHHSDHRSGEVFTDAKGRPALPYYGVPLDRHIVPGTADPDEPDEAARIGRLTNPTVHIALNQLRRVVNRLIRVYGPPAEVALELARELKLSEDEKKERNRENSRNRLDAEKRSSKLAELGQRDNGGNRALLKLWEELNPENILDRRCIYSGRQISIGMIFSGAAEVDHILPFDATLDDSNANKILCLREANRDKRKRSPFEAWGGTPQWEEIAERASRLPRNKRWRFEPDAMERFAEEGGFLARHLVDTQYLGRIAHDYLRCLYPDKGDGSSHVWVSPGRLTEMVRRKLGLNGLLGDHNLGAEQPKNRKDHRHHAIDAVVTAILDRSMLQRIQRASGEGASDAELLRIIVPEPWTGFRDDLQRAVDRIVVAHRADHGTVAKAATRGRDQTAARLHNDTAYGFTGEADAKGTPIVVHRAPLGALKKPEHIDQVRDPLLRAALHDFTAGLSGKPFEDRIAAFPRLGPLDYRGIRRVRVVEPLQVIPIRDAAGRAYKGYKGDSNYRYDVWELPDGKWEQRVLQMYYAHQSGEPPRPHPAARKVLSLHRDDVLAIERGEGGRELVRVVKFSTNEFTLAPLNEGGALKSRHADKGDPFRYLYPSPSTLKAWRAREVRVDELGRVLDPGFPARKRRRVTRPGRADAD

SEQ ID NO: 647 - protein, 1106 aa, Artificial Sequence
  Cas9
MQYIVAIDIGVASVGYAVIDKTSETVIEAGSNIFPEASATDNQERRGMRQARRLKRRERTRLDDFTKLWEYHGLAIPQVKKNDIVGLKVKALYESISLDEVYLILYSYLKHRGISYLEDVEDSSVSGSTAYANGLKLNAKELEKNFPCEIQKYRLENIGKYRGQIQIEDDQGEKLDLSNVFTIGAYTKEIQQILDTQKKYHAEIEDEFCEKYLKIFTRKRKYYEGPGNEKSRTDYGKYTTRLKENGEYITEKNIFEKLIGKCSVYKDELRAASASYTAQEFNLLNDLNNLTVNGRKLEENEKHLIVDKVKTSNTINMRKIIADAMGEKIEEFYGARIDKSEKEIFHKFEVYNKMRKALAAIHVNIEEFSRDDLDEIGYILTINTDKEAMMEAFDNSRLELPGEIKNCLISLRKTNGTLYSKWHSFSLKIMNELIPEMYRQPKEQMTLLTEMGVMKGQTDEFEKNKYIPVDVASEDIFNPVVRRSVRISFKILNALMKKYGTLDEVVIEMPRDRNSDEQKKWEKETQKKNEKEQEYIENKLATVYDIRLSSADFSSQKQLNLKLKLWNEQDGKCLYSGKIIEPEDLIKHSELFEIDHIIPRSISFDDSRSNKVLVYRTENQNKGNQTPYYYLTHTNSKWSFEQYKALVMDLSKKKEYGLSKKKVRNLLYSEDITKADVLRGFINRNINDTSYAARVVLNTVQGYFRAKEMGTKVKVIRGSYTHQMRVNMKLDKDREKSYAHHAVDAMLIAFSQLGYEAYRKLQGEFIDFETGEILNSEKWKDQMSDEVYKQYLYRKKWSNIRNEITRAEKNVKYWYYVDHKSNRGLCNQKIRGTRVYDGKIYKINKLDIRKKEGAALFKKLAFSEKESDREKLLVYKNDKKTYEDLVRIMQDYSDSKNPFVQYEKETGDYVRKYAKKHNGPRIDKLKYIDGEVGSCIDISHKYGYEKGSRKVVLESLVPYRMDVYYKKEEQTYYLVGIKQSDVKCQKGEYVIDEDAYAINLVKEKMIQQGQKRSDLESLGFEFQLSFYKNDIIEYEKDGKIVRERFLSRTMPKVKNYIETKPIDRAKYEWHDRKLVGLGKTKRIRKYRMDILGNYYLCNKEEFSKYC

SEQ ID NO: 648 - protein, 1107 aa, Artificial Sequence
  Cas9
MGYTVGLDIGVASVGVAVLDENDNIVEAVSNIFDEADTSNNKVRRTLREGRRTKRRQKTRIEDFKQLWETSGYIIPHKLHLNIIELRNKGLTELLSLDELYCVLLSMLKHRGISYLEDADDGEKGNAYKKGLAFNEKQLKEKMPCEIQLERMKKYGKYHGEFIIEINDEKEYQSNVFTTKAYKKELEKIFETQRCNGNKINTKFIKKYMEIYERKREYYIGPGNEKSRTDYGIYTTRTDEEGNFIDEKNIFGKLIGKCSVYPEEYRASSASYTAQEFNLLNDLNNLKINNEKLTEFQKKEIVEIIKDASSVNMRKIIKKVIDEDIEQYSGARIDKKGKEIYHTFEIYRKLKKELKTINVDIDSFTREELDKTMDILTLNTERESIVKAFDEQKFVYEENLIKKLIEFRKNNQRLFSGWHSFSYKAMLQLIPVMYKEPKEQMQLLTEMNVFKSKKEKYVNYKYIPENEVVKEIYNPVVVKSIRTTVKILNALIKKYGYPESVVIEMPRDKNSDDEKEKIDMNQKKNQEEYEKILNKIYDEKGIEITNKDYKKQKKLVLKLKLWNEQEGLCLYSGKKIAIEDLLNHPEFFEIDHIIPKSISLDDSRSNKVLVYKTENSIKENDTPYHYLTRINGKWGFDEYKANVLELRRRGKIDDKKVNNLLCMEDITKIDVVKGFINRNLNDTRYASRVVLNEMQSFFESRKYCNTKVKVIRGSLTYQMRQDLHLKKNREESYSHHAVDAMLIAFSQKGYEAYRKIQKDCYDFETGEILDKEKWNKYIDDDEFDDILYKERMNEIRKKIIEAEEKVKYNYKIDKKCNRGLCNQTIYGTREKDGKIHKISSYNIYDDKECNSLKKMINSGKGSDLLMYNNDPKTYRDMLKILETYSSEKNPFVAYNKETGDYFRKYSKNHNGPKVEKVKYYSGQINSCIDISHKYGHAKNSKKVVLVSLNPYRTDVYYDNDTGKYYLVGVKYNHIKCVGNKYVIDSETYNELLRKEGVLNSDENLEDLNSKNITYKFSLYKNDIIQYEKGGEYYTERFLSRIKEQKNLIETKPINKPNFQRKNKKGEWENTRNQIALAKTKYVGKLVTDVLGNCYIVNMEKFSLVVDK

SEQ ID NO: 649 - protein, 1107 aa, Artificial Sequence
  Cas9
MGYTLGLDIGIASVGFGLIDNVDGKILESGVRLFSSADPDNNQTRRSSRQARRLNRRKVHRLERVAHLLEEAGFEKGEVLAPTPYHLRVKGLTEKLSKPEVYAALYNLMKHRGISYLEDVELDEADSSSVSQNVELLKEYYPCEIQLERYEEYGQIRGIIETYNKDGEKESLVNIFPTGAYKKEAEAIILKQGQFYPELDKVFLEKFTEILTVKRPYYVGPGNKKSRTDYGIYRENGETLENLFDILIGKCTIYPQEARAAKFSYTAQLFDFLNDMNNISIAGEKLTEVQKREIYHQIMSSKTVNMMKIITKVTGCLKEEVTGYRVDSKYKAEFHSFASYRQFRNKMLDYGFDVQTLNVEMFDKLAAKLTLNTEYHQIITQLESLNLGLSKELIEKIADFRKKNRSLFSKWHSLSLKAMNEVVDELWSTSKNQMQIFSELGGFKSNIEVFKGLKYIPLDAMVDEIYNPVVRCSIRESIKIINALLKKYGALDKVVIEMPRDSNEKEEKDRITKLNKENDNKKKQAIEKARNEYGFGEEAYRQQNDLNTKLRLWYEQKQRCLYSGEIIKIFDLIKNPHLFDIDHIIPKSISYDDSLSNKVLCYATENREKGNLTPYRYFKRKASLTWNYEAYKSYVIELYKDGKGDLSRTKLELLLFEEDINKYEVRQRFINRNLVDTRYASKVVLNTLQDFMKENYPTTTVEVVRGKFTAQLRRHWGIRKNRDENHAHHAIDALIIACVPHLSLWKEQKKVFSTDEFRVDETTGEIIEQSYNQLTYQEPFSQFFYQLEKVSIDCRYSYKVDRKFNRQVADATIYSTRQGIVKQTSGDKSFTLDSNSKEHYVIAKIKNIYEDVDAKRFMDRYKKDKTQFLMYHHDPQTFSILEDVMKTYPDKKNPFQAYRLEYGPIRKYSKKGNGPQIQSIKYYDSKLGQHIELKQANQSTKKVVLQSLNPWRCDIYYNKKDKRYIAAGLKYADLSYQKGTGLYGISLQRYQQILNSEKIELSIEQIELLLEGRLNESNFEFCFSLYKNDFIQWNDENNQTFQYRFLARNLSSPNRIEVKPINKSKYDKQAEGLKTLKKGLNRFYKISVDVLGYQHFIKKEKLKLTFK

SEQ ID NO: 650 - protein, 1109 aa, Artificial Sequence
  Cas9
MSHYVLGLDIGITSVGYGIIDLDTNDFIDYGVRLFKEGTAANNEDRRNSRSRRRLLSRKHTRLMDMQKVLKEAGIMTESYSPLSNVYEIRKKGLTKELTNDELTAAILHITKHRGSVIETVEDDEAAAKETGELKSTLHENALLLANNKFVCEIQLERLNTENKIRNHKNNFKTKDYVAELKEILNHQNLSEEVKNKIIQIVERRRAYYEGPGSFNSPTPYGRFIEVNGQVQEIDLIEKMRGKCSVYPDEFRAPKMSISADLFNILNDFNNLLVQGEKLQEEDKKNLLKIINDKGSITLRQISKKLEVNEDEIKGYRIDKKGKALFTEFKGYKILKKLFLNCGQSISLEDYEMLDEIIEIVTKKKGIDERKDALKELKWDLSDDIINSLSEVTGIVGYHSLSLKAIRELDSELYKTSLNQMQLLHELKMFDKNRPSYKGKKNIVADPEAILSPVAKRAQNETFKVINALRKKYGEFDSIVVEMTRDKNSQEQKKRINDSQKALESLNKEVDQLLQQKGYDPQKVKGKTKQKVRLYMMQEGKSAYTLQELDLHRVIKDDKYTEIDHIIPISISLDDSQSNKVLALHSENQQKGNLTPFMAFHTGRFADMGCTWNKFKENVLSNKNYKHKKKNNLLDERDINKFSVIQEFINRNLVDTSYANRVVLNTLTDYFKDNEIDTKVHTVNGKLTDLFRKRINLKKDRNEDYLHHAIDALIVASIKKLRLLDGYLAKYGFETLYDEMTGEIKEIPEDKAFFDDKYIRYILNLKTIYESSNMYYRGILEREELIYQPIKISHKIDTKPNRKVSDETIYSTRIIDNEDHLIEKYSDIYDPKFKNLTEDILNGEKNKYLMEKNDPQTFNILKQIIFNHYNTYKDSKEYYKIEKKKEKEIIKLVGINPLSLYKEENGPIKKYSKKGNGPVIMSMKYDSEKLGNHIDITPDSAKNKKVILKQISPYRTDFYKCSDEKFRFVTVRYKDVHYQKSIDKYCIDKEWYQNEKKNKKIDEKAEFLFSMHHDELIGITRKESEQFIYDESKENHGDPRYHDGVKPEILKFTATNNDTKGIIEVKPLYTYSAYRLKPTVLNVKNIKKYATDVLGNLYEVKQNELKLEF

SEQ ID NO: 651 - protein, 1110 aa, Artificial Sequence
  Cas9
MAEGKKRIWRLGADLGANSLGWAAIELSAPVNGKPIAILAAGSRIFSDGRDPKSGASLAVDRRDARAMRRRRDRFKQRQKALIKYLIADGLFPADEAARNAMAAIDPYAVRARALDEALSLPELGRALFHLNQRRGFKSNRKADRKADDDAGKIAIGIDRTRDAIAEDEADAGAEPGSWTFGKWLHERRLKGQSVRTRLRPESGEDAKGDGYDFYPDRALMEEEFDAIWAAQAPHHPDVLTNDVHDRLHEIIFYQRPLKAPQVGMCSLIPGDRRLPKAHPLFQRRRLLEELNALMIVRPGEVAQRLTREERDILLLKLKDKNKVSFATLRKALKLDPDARFNKESEDRTDLKGDEVAAVMGSKTRFGNLWVHLSIEAQWDVLARLDAVESDAEDAAFCAWLVETYALTPEQARAVANAPLPPGYGRFGETATRKLIEALRDGKKDDRVLVYSEAVTEAGLGHHSDRRTGEVFEDAKGRPQLPYYGVALERHIMPGTGDPSDPEEMRVGRLTNPTVHIGLNQLRRILNVLIRAYGPPAEIAIELARELKLTDEDKKRINRENNDNRIAAERRSEKLLAIGQADSGANRALLKLWEELNPANVLDRRCIYSGRQISIDMLFSAAVEVDHILPFAATLDDSNGNKIVCLREANREKRKRSPHDAWGHSARWDEIAARAAQLPRNKRWRFEPDAMDKFRDEGGFQARHLVDTQYLARLSREYLATLYPEKGEGSGHIWVSPGRLTEMVRRKLGLNDLLPDHNFGGGADQAKNRLDHRHHAIDAVVVAIVDRGMLNAIARASGQEGAEGRERIIIPEPWDGFRDALRETVNRITVSHRTDHGTASKAGLPKGKDATAGRLHNDTAYGFTGDTDAKGNSIVVRRVPLSSFKKLADLDRIRDADLKAALYQHLNGLEGKAFEKALAEFHKLEWHNFGGVRRVRVTEPLTVIPIKDRNGRIYKGYKGDSNYRYDVWELPDGKWVTNWKNEAGEAMSSVISMFDAHQSSEPPRPHPAARKILSLHQNDLLAIEREGEDRKLMRVVKFGQSGQITLAEHQQAGDLKKRDAVSNDDDPFKYFAPTSGGLKKVKARQVRIDEIGRVLDPGFPARTARRKTRG

SEQ ID NO: 652 - protein, 1110 aa, Artificial Sequence
  Cas9
MTARTHKIWRLGADLGANSLGWAAIELSAPVDGKPIAILHAGSRIFSDGRDPKSGASLAVDRRDARAMRRRRDRLQQRQRALIKYLIADGLFPADENERKAMATIDPYAVRARALDEALTLPEVGRALFHLNQRRGFKSNRKADRKADEDAGKIAIGIDRTRDAIRQAEEEAGAEPGSWTYGKWLYERRASATDANAIPSVRTRLRPETDEHAKGDGYDFYPGRALMEAEFAAIWEAQAAHHPDALTNEVHDRLHEIIFYQRPLKAPQIGVCTLIRGDQRLPKAHPLFQKRRLLEELNALTIVRPGEMAQRLTREERDTLFLKLKDKAKVSFVSLRKTLKLDPDARFNKESENRSDLKGDEVAAAMGAKTRFGNRWVHLSIEEQWDVIARLEEVESDAEDAACRAWLAATFDLTPEQIRAVTNAPLPPGYSRFGKVATQRLIDALRDGEKDGRVLVYSEAVAAAGLGHHSDLRTGEIFEDAQGRPQLPYYGVALERHIMPGTGNPDHSDEMRIGRLTNPTVHIGLNQLRRIVNTLIRAYGPPAEIAIELARELKLTDDDKKRINKENNENRLAAEKRSEKLLTIGRPDTGANRALLKLWEELNPANVLDRRCIYTGTQISVDMLFSAAVEVDHILPFTATLDDSNGNKIVCMREANRTKRKQSPYEAWGHTDRWEEIAARAAQLPRNKRWRFEPDAMEKFKDESGFQARHLVDTQYLARLSREYLETLYPGSGEGSSHIWVSPGRLTEMVRRKLGLNDLLPDHNFGGGADQAKNRLDHRHHAIDAVVVAIVDRSMLTEISRVSGLEGAEGRERIIIPPPWDEFRNDLRTAVNAITVSHRTDHGTISKAGLPKGKDATAGRLHNDTAYGFTGETDAKGNSIVVRRVPLASFKKLADLDRIRDTDLKAALYQHLEGLEGKAFEKAVMDFPNLEWHPFGNVRRVRVTEVLSVIPISDQNGRIYKGYKGDSNYRYDVWELPGGKWEAEVVSTFDAHQPDWVSKIRSRSPTARKVLSLQQNDLIAVERAHETRELMRVVKFRQNGEITFAPPQEAGSLKRRDATPNEDDPFKYFAVAASSLQKAKARQVRIDELGRVLDPGFPARTARRKTRKST

SEQ ID NO: 653 - protein, 1110 aa, Artificial Sequence
  Cas9
MRILGFDIGITSIGWAYVEGEELKDCGVRIFTKAENPQNGDSLAAPRREARGVRRRLARRKVRLNVIKRLLCKEFGLNLSDYFANDGELPKAYETTKDTKSPYELRSLALEQKLEPKELARVILHIAKHRGYGNKHAKRDLEAEEKAKKAAEKAPQEKESTTTNGDSKKEQEKVLKALYQNETLLKKYQTNYQTNNKTNDETNNKTIFLVGKYLYKEFQDKGQRIRNTTNNYQHTMRQEWLKDELEFIFKKQKDFGATFSENFESQILETAFYQRDLKSFEDKVGKCVFYENENRAPKDSLSAMEFVALTRIINTLKNLEKKSKNLGIGETYGKDKIQEILKIVLDKGEMSYKELRKILKLNESILFAKDSKLDYTKGMQEAEKAKFIELKNLKAFKKAMGGDFSKFPREELDKIATDIVLIKSKENLAKKLQNYSALSKEQVEALSNLNFAKHIDLSLKALDKILPFMREGLSYDEVVKKVGLQEHRKYKQKGEFLIPLKEYEPYLANPVVARALSEYRKVLNALLRKYGNVHKIHLEFTREAGKNYDERKKIEKEQREHFEANQKAIKQREILGLPINGANILKMKLWIEQGECCVYSGEKITSKHFFDSNALQVDHIYPYSRSFDDSYMNKVLVFAKENQNKLNKTPFEAFGSDKEKWDRILSLSAKLPKQKQRRISNKDFKDKELGFIARNINDTGYIARLASQWTNNCLKFEDLRENEVTIAGEKGSKNHLEVISGQLTSMLRHYWGLGDKDRNNHLHHAVDAVIIAYTNAKTIKAFADFKKNQEQNRAKFYAKQISEQEYKRQRNPFEPCANFRQRVEEKINKIFVSKPPRKRARGALHKETFGSICLDGNNNWVARFKIKSKKEQEDITKEKATKAKYKDEFKGEENIRKALKLGKIRRINNTQKDIAIGDKIVKNETMVRVDIFKDKKGKFYAVPIYTMDFALGILPNKAVATGEDEDGVIKDWIEMDKTKYEFCFSLFKDDLIKVRKKKMKEAELCYFVGFDTDGSRIIVAKHNNDYQTMTENECKLFTLKEKKKKQKTLNDEEDNQERIETEYKIIGGRTGIQNLETFEKHQVSPLGEVQKAEFEDRQEIKLKSSPKGKD

SEQ ID NO: 654 - protein, 1110 aa, Artificial Sequence
  Cas9
MSEKYRLGLDVGTNSLGWAVIGLKEDVPSSVLATGVRIFSEGRDAKTKSTLKASRTEKRSARRRRDRFLQRQTFLISEMVKSGLFPKDIVEQKNLELLDPYEIRFKALTEQVPLHHLGRALFHINQRRGFKSSRKDKSEETTSGVVSKSVRALYEEMQLINPAPVIDDPKALSKEERREIRVQEASSREEALVTLAEQKGVTFGAFLYRRLQSGKSVRARKDADSQLYDVYPTRELLKDEYSKLMQHQAQYYPNVINEALISRLHDVIFFQRKLKEQERGFCTYYPSERRTFRCMPSFQQYRMVQELNALEWVDAAGKHCLRDYPESRDLILSELENISTKAGEFTFGNMKKILKKMGVIDGEVSFNFEGPKRKGFQGNVTSREMRHEDCFGTRWDELSLDEKDDIIDKINDDHLDDEDMERYLIDTYGLSSFSVGNAINARLLEGTANVSRKAARTLYETMLSANCLQSDAVIAVSEQDDTFVNPYSRTGRGELLSELPYYGEAFQDGRHIIPGKREPKVSHDQLKFYGGVSNPTVHIALNQIRLVVNEIIKRYGLPSSISIELARNLPEGQDGRRKIEKMQSENQKNNERYDQILTENGQSPNRDNRLRLALWEELGEGPTDRLCVFTGKLIELADLFNGSVEIEHLIPFSVSLDDSKANKTVCWKEANRFKGNKTPYEAFANNSGDYSWEEIMERVRALPNSKQWRFQEDALKIWNSDHSDFSGRHLNDTRYISRLAREYLENICPFNKIDVVTGRLTALLRGHWGLNNILRGHNEPETATPKKMRDDHRHHAIDAVVIAMTSLTILQKVSSAAGKAEELDVGKLFAKDESGRSVIDPWDGFRDEVAEKVRNIIVSHKTKRKTIGNSGKSTDRALHNETAYGLIDGPDEKGLYSVVTTKPISYFDNRDKIEKIRDEKLRDDFLTAWDGEGDNKASQLAVLDKASGLNVKKCRYVERKKVIPINGPDGQPYKAYDGNSNWGMEIYEFPNGHPKEKKWNGVVISTYDANKSEFKPGETFRPHPAAKLVMRLHINDIVEVQNDGEPILYRVQLISAGTLTVSPLHEANVDSRNRDKHDEFKYKSLSVTPMQKMGAKKVNISPTGLKNYSR

SEQ ID NO: 655 - protein, 1114 aa, Artificial Sequence
  Cas9
MGIIIGLDIGIASVGIAVVDKDTLDIKCVVSDLFDSADASKNIERRNNRQARRLNRRRKTRIGDFNTLWVSMFGELPEEVDSNVLLLRNAGLDEQLTLDEIYCVLKYMLKHRGISYLEDALNEENVTGSYQKGIAINQRESEYMLPCEIQLERFRKYGQYRGECEAENENGEKITLSNVFMTNSYRKEIDKFLNTQGKYGILNQKFIDEYLKIFNRKRKYYEGPGNEKSRTDYGKYTTGKDLDGKYITEKNIFEKLIGKCSVYKEELRAAGASYTAQEFNILNDLNNITVNNKKLTTQQKKDVIEIVQNSDRINMEKIISSCIGEKIEKIEGARIDKNEKNIYHTFEQYNKMRKIFAEKNYDIKELTIEQLDEIGRILTINTEREGIKDAIMESELLHLNNEQINLLIELRYKNSSLFTKWQSLSIKAMREIIPDLYDRNVNQMNILAERGVFKDKINLFENSVYLPKEPVLEEIYNPVVRRSISMTIDALNALIKKYGYPEDIVIEMPRDRNDAEQKDRIKKFQKTRENELKNIKKKIKEEYGIEITDEYFRKHKGLELELKLWVEQNEKCPYSGKYINVQDILYHHELFEIDHIIPLSISYDDSRNNKVLVYKEENQDKGNRTPLMYLSTVNRQYDQHEFMNYVLSTKTLPRKKRELLLNYEDITKIDVLKGFINRNLNDTRYASRSVLNAIQLFFGGKECDTKVRVIRGAVTNQLRIKLNLPKDREKSYSHHAIDAAIMCYSQMGLMNFRNIQNKFIDFENETYLSDERDSCFDNKYYDEALFGQVLKMRKNLLKAEGKPQRSVQSKGVFDEEEKNNGIVRYHHKVDKKPNRGLSNASIYGTRKIDDKIYKIVGYDIRNNKDAEAIINIIKKGKSDNFLMAKHDPETFKNLMEIYEQYKEEKNPFLAYEQETGDYIRKYAKNHNGPIIKKIKYVDSEVGSCIDISANYGYKNGDKRVIMDTLTPYRADVYYNYKDGTYRIIGVKYADFKYSNAKYVLDEEAYALILIKEGLLKIGDSLENISSSGYEYRLSFYKNDIIEYTKNDIVYKERFLSRTMPKVKNYIETKPISAALYEKRNPIGLTNATNICKIYTDVLGNETKIYKEKFKLSVD

SEQ ID NO: 656 - protein, 1114 aa, Artificial Sequence
  Cas9
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 657 - protein, 1115 aa, Artificial Sequence
  Cas9
MSATYTIGLDIGIASVGWCAFGETHILDLGVRAFDKAETAKEGESLNLARRNARLMRRRLFRRTWRLKKLARQLKSEGLIADTKLFKPELPFSKSLWQLRVDGLDRRLNDEEWARVIYHLCKHRGFHWISRAEAKQAEGDSKSEGGKVKQGLAGTAKLMDEKGYRSAAEMVLAEFPQAQRNKQGEYQKALSRELLAKELALLFAQQREYGNLHTPGALETAILGNGDKKSGLFWQQKPALAGTDLLKMLGTCTFEKGEYRAPKASFTAERHVWLTRLNNLRIVTDGVTRQLTEQERQLCLPLPYRQAGDLTYKQLGSALAKAGLLEAGGFKFTGLAYPTEAQKAEGKAKDPESATLVKIPAWHELRQTLTKGGLNDEWEKLAGDALCGQPEIFDKIAWVLSVYKDDDEVRAELAKLALPNPQALTEALLNIRFDKFHSLSLKALRAIVPHMEQGLRYDEACVQAGYHHSQLLKVGEGEHKYLPPLYDGRDGDGRMIFAEDADIPRNPVVLRSLNQARKVVNAIIRRYGSPSAVHIEMARDLSRPFDERNKIKKDQDEYQARNQRDREQFSELFGHPPKGLEFEKWRLYREQNGQCAYSQRPLTASGNVAEIFLDGSTEIDHALPYSRSFDDSKNNKVLVLTRENRDKGNRTPYEYLGGAENSESWQRFVSFVESNKAYRLAKRTRLLRKDFGAKESEEFRERNLNDTRYVCRFFKNYVEQHLKLAEGSETKRCVVVSGQLTNFLRARWGLLKVRSDSDRHHALDAAVVAACSHSMVQRLSNYSRTRELEQVRDGFVDIETGEIVNPAMHQQLREHFPDPWPYFRHELEARLKIDSPELLREEMARLGSYSEEELKVLKPLFVSRAPQRRNGGAAHKDTIYGQPEKLKKNGSVTQKVALTSLTLKDIDLLADPHRNAKLYGAIRERLEAHGGKGDKAFPATNPLRKPDKEGNPTGPIVRTVTKVIDKLSGIPVRGGIAKNDTMLRVDVFTKGGKFHLVPVYVHHRVTGLPNRAIIAFKDEDEWTLIDDSFDWCFSLYPNDLLRIKLKKESHSGYYSSCNRSTGAVNLWAHDRNVNVGKDGFIESIGVKMAVSIEKLHVDTLGNIYPAPPEKRRGLA

SEQ ID NO: 658 - protein, 1116 aa, Artificial Sequence
  Cas9
MSQNQNPNTQSHLNPTTQSSTQSNPQPTTQESLKILGFDIGVASIGWAFVEGGELKDCGVRIFTKAENPKDGSSLALPRREARGVRRRLARRKGRLNALKVLICKEFGLNRSDYLATAGELPKAYATSKETKSPYQLRAESLERKLSADEFARVILHIAKHRGYGNKHAKESSDDDSGKVKKAISENQKVMSEKGYTTAGQYLYGEFYQKARNFSEAEPKSPKNARGTQEFKNVRNKSENYARCLAQSELQKELEIIFAKQREFGFQFSDKKHKTINANGKLKELDFADAVLEIAFLQRPLKSFADKVGKCTFYEDKPRAPKDSLSAIEFVALTRIINTLANITKRSGEVYSADKVREILSIVLDKGEITYKNLRKVIALDERLQFPKDSKLDYAKEDAEKAKAIEFSKLKAFRKALGGSFEGFIRAELDSIATDIALIKSKDELKAKLANYQSLNDEQREKLSELSFDKFIDLSFKALEAILPLMRGDKDDKIYRYDEAWREAGLVEVAKKTQKGDSLPPLIEYEKDLANPVVARALAEYRKVLNALLKKHGKVHKIHLEFTRQAGVSSKERGEIIAEQNKRLKANEEARKRCEEYGLIPSGKNILKLKLWQEQGEFCVYSGKKITQSDLRDESTLQIDHIYPYSRSYDDSQNNKVLVFTDANQNKLNQTPYEAFGKDISKWNQILGRIEKLPKAKKNRITNKNFANKEAGFIARNIVDTSYIARLSASYTDAFIEFCPLAENEDTTLGRGEKGSKKHISVVNGSLTATMRHYWGLNTLLDGENSESKDRSNHLHHALDAIIIAYVNDSVIKAFSDFKKTQEQNKARLIAKEIESAEYKISRRFFSPSGFENNEAFRQAIKRKILGQSLESRENDMTINSEALGEKVGGIFVSKPPRKRARGALHKETFSSIDDKDLLKTYGGKEGVNRAIKLGKVRQIGSKIADNGTMVRVDIFRHKVSGKFYGVPIYTMDFALGILPNKAVVGGKDKSGVIKDWLPMDSNYEFCFSLFKDDLILVQKKEMSKAELCYFAGFDTSGGQIKVEKHDNHFATLTDNQRLLFNIATPKEVAGKSIGIQNLKVFEKWQVSPLGEVSKAEFKEREPIALKSTPKRFLQG

SEQ ID NO: 659 - protein, 1117 aa, Artificial Sequence
  Cas9
MKHILGLDLGSNSIGWAFVQQDFENKQGKIIATGSRIIPMDQGILGDFERGNTVSQTAERTTYRSMRRLRERHLLRRERLHRVLHLLGFLPPHYDAQIDFTKRYGKFIDNAEPKIAYNNGNFIFMNSFNEMVEDFKKHQPQLFYKKSNGEESRIPYDWTIYYLRKKALSQKITQQELAWLILHFNQKRGYYQLRGEEETENPNKEVAFHSLKVVDVEAEAPNKKGEIWYTIRLENGWIYRRTSKNPLDDWKGKTRDFIVTTDLNDDGTIKLDKEGKEKRSFRAPDENDWNLLKKKTEHDIDFSGKPVGTYIYDHLLQNPNQKIKGKLVRTIERKYYKDELKAILAKQIALQPELFTETLLADCIRELYRKNETQQQNLLSKDFLHLFVEDIIFYQRPLCSKKSTIANCTLEKRSYIDKETNERKDAPIKVCAKSNPYYQEFRVLQWLQNLRIYEIETDREVTAEFIETPQDYEALFNFLMSQKEIDNEGLLKYFLFAKNPQIKDKAAKSELKKWLTTYRWNYVYDAADNSSKKYPMNETGYELQRYLQKVEGLPANFLTFDITYQLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYSGGQANFFDEIHIELGRELKKTAEERKQLSDKNQENENTNLRIKKLLAELKEDASIQNVRPYSLVQQELLKIYEEGVFSSTDEIEEDIQKIRKKVEPTPPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKCISEILSKIVRSDEKDEGVNSKNIIPCTGKITTALKQDWGLNDVWNELILPRFERMNQLTQTQLFTSYNDRLQKNLPTVPIEYSQGFQKKRIDHRHHAMDALVIACATREHINYMNNQHALDKSKDKKEKQQSRIDLHPL

SEQ ID NO: 660 - protein, 1117 aa, Artificial Sequence
  Cas9
MQTKNLLYTLGLDIGIASVGWCVLGENRIIDLGVRCFDKAETPDRGESLNKVRRDARLMRRRLRRRAWRLTKLARLLKHAGLIDSTRIVRDRHDGAVSPWQLRVEGLDRKLAPEEWARVIYHIVKHRGFHWISRAEERKAESDKGEGGKVKQGLSATKQLMVEKNYRSAAEMVLTEFPGAQRNKRGEYTKALSRILLAAELTTLFERQQELGNPHAGPDLQTKILGNGDRKSGLLWMQKPPLSGSALLKMLGKCTFEREEYRAPKASFTAERHVWLTKLNNLRVLVDGVTRPLSDPERRLALSLPYQQASDFTYKQLRAALCKNGLLPDSFQFSGLAYPTGAQQPDGKAKNPENDRLVKLPAWQEFRKTLRDAGLETEWESIAGMAAGGQPDLLDQIGWVLSVFKDGDEVLRELRKIPLPGGEKMVQALSGVSFDTFHNLSLKALRKIVPHMEAGLRYDEACLAAGYHHSDLRKDTDERSLYLPPLYSGRTTDGRMVFRDDIDVPRNPVVLRAINQARTVVNSVVRRYGSPSSMHIEMARDLSRPWDERNKVKRAQEEYRDRNEKLKIDFAAEYGIEPKSREFEKFLLYREQGGKCAYSLKPLDLDRVLRDLGYAEVDHALPYSRSFDDSKNNKVLVLAEENRNKGNRTPYEYLDGTSESPRWREFKAFVETNKAYRLAKRARLLRKDFSGKGSEEFRDRNLNDTRYISRFFKNYVERFLKLAEESEERTCVVLSGQLTAFLRARWGLAKVRGDSDRHHALDAAVIAACSRSMVKRLSDYARRHELEKVRTGFVDFETGEIVDAGKYRQIERDFPSPWPYFRDELLTRLNTDDPAELRERMQSLGSYPPEALETLRPMFVSRAPQRRNGGAAHKDTIYRQTERLKKVGSVTQKVPLAALNLRDLENLVDPHRNEKLYAAIRARLEAHGGKGEKAFPPNNPLRKPDRDGNPTGPIVRTVTLVIDKMSGIPVRGGVAKNDTMLRVDIFRSKKDGKFHLVPLYVHHAVAKQLPTRAVIAYKDEGEWTPINNHDFDFLFALYPNDLVRITLKKERHFGYYAGCNRATGAVSIWAHDRNQRIGKDGFIDGIGVKTALSVEKFHVDTLGNVYPAPPETRRGLA

SEQ ID NO: 661 - protein, 1118 aa, Artificial Sequence
  Cas9
MGTRYSFDIGTNSIGWAVWRTGRDPKGIFGEKDAPLELLGAGVRLFKDGRNPKDGQSLATMRRIPRQARKRRDRFVLRREALVAALIEAGLMPASEKERKALADLDPYQLRAAGLDKALAPHELGRAIFHLHQRRGFKSNRKTDRKSDDRDKGKIATASAALAKKFEDENARTFGEFLWRRHRDPDMKRQAVLKAHDPAKGKPDLRAAKLRQPTRIRLEGQGATALYEFYPTREMLCHEFDALWEAQARHHPMLLTREAGDKIRSILFRQRELKPPLIGLCTFEYAAGEKESRLPKALPSVQAREIYERLGHIRLSTGSGTDRPLKSSERDDLATALLHCGLTKIKVSKTKGLAFKTEFRKALRLGGEVRINFEEMGEEGLVDLRTNRLLVQDDHYGPRWRALSWSGKDAFVKKLLEATDDDKLVARLMTEDGLSAVQARNAASIPLPDGYSRLGPTANAAILQALIDSRDENGFVVTYDKAVRRAGERLGKDWHHSDERDGEILDALPYYGKVLQRHILPGMMDPADRKDEAKFYGRIMNPSVHIGLNQLRRLVNALIERFGPPDQIVVELARDLKMSAREKEQEQRRNRDNREANEKRTKKLVELGQDNNGENRARLKLYDEQQRAGNGVAHCPFTLDPIGITQLFSPEIEIEHVLPRSRTLDDSAANKVLCFRTINRIKRGKTPWEAFHADPKWPDIAANAEKLPPNKRWRFREDAMDVFEARTSGKMDKTTLEQMGLTTGFQARHLNETKHMSRLAKAYLGKICDPDAVYVTPGALTSLLRGKWGLNSILSDDNLKDRTDHRHHAIDAITIGAMTRSLLLELNTLAGKAEQSDYDDVVGKVPWPFDNFRDAVRSVVDRVVVSNKPEHGKQGALHEDTAYGIVGDEAEAEEIGNLVRRKLLVDLTPGEVDRIRDAGLRKAMQAAVAPSRDARGKVSDAKGFAAALDTFAKAQGMRRIRVGKEDMSAVTIHDRQTDKAYKAVAPGENHHVDVVQMRDGAWKGFAVTVFEANQKDFRPQWEREKLGGKLVMRLHKGDAVELESSGVRLVKFVQQIWMKSNLVLLTEHNEGGDLQKRHQDADDPFRWDFANIGKLKERGCVAVKVDELGRVTKRISNT

SEQ ID NO: 662 - protein, 1119 aa, Artificial Sequence
  Cas9
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 663 - protein, 1119 aa, Artificial Sequence
  Cas9
MNDKKNLGPLTFGFDIGIASVGWAVLSPTRIVDLGVRCFDKAETAKEGESLNLARRSARLMRRRLRRRAWRLIKLARLLKHEGLIADTKTFIQPSASHASPWQLRKDGLDRALSPEEWARVLYHLCKHRGFHWVSRAEARKADGDTKGEGGKVKQGLASTTKLMNDKSYRTAAEMVLAEFPSAQRNKRGEYTKALSRELLDNELKQLFERQREYGNPHADTNLEAKIRGSGDHKSGLFWEQKPALSGNDLLKMLGKCTFEKQEYRAPKASFTAERHVWLTRLNNLRIIVDGRTRPLADAERTMALSLPYEQVGDFTYKQLRAALVKAGLMPDSFKFASLAYPSEFQKAEGKAKDPESAALTKLAAWQELRATLKKADLESEWQQISCAALEGQPETLDEIAGVLSVFKDDDEVLNELQKLGLPGGAKTENALLDIRFDKFHALSLKALRKIVPYMERGLRYDEACERAEYHHSQLHKVGEGNRKYLPPLYKSRDKDGRMVFNDELGDIPRNPVVLRSLNQARKVLNALIARYGSPSSVHIEMARELSKPFDERMKVGKEQEAYRERNEKDKQTFVAEFGIVGAAKGGEFEKWKLYREQQGKCAYSIQGIDLNRLLEPGYVEIDHALPYSRSFDDSKSNKVLVLAAENRNKGNRTPYEYLDGEHNSERWRQFVGFVESNKLYRQAKRSRLLRKDFGKEQADEFRERNLNDTRYVCRFFKNQVEQFLKLAEGSESKRCVVLSGQLTAFLRARWGLIKVRDESDRHHALDAVVVAACTHGMVKRMSDYARRKELDQVAEGFVDVETGEIINAAMFQQLHEHFPDPWPHFRDEVQMRLKIDDPAQLRSDLLRLGNYAEEDVHAVRPLFVSRAPQRRNSGAAHKETIYGQPERLKAQGGVTEKVALTALTMKDLDRLIDPHRNEKLYAAIRKRLEEFGGKADKAFAASNPLHKPDKEGNPTGPIVRTVTLEIDKLSGVPVRGGIAKNDTMLRVDVFTKAGKFHLVPVYVHHKVTGLPNRAIVASKDEDEWTAIDDSFEFLFSLYPNDLVTITQKGKAPVRGYYASCHRGTGAFSLWAHDRASSVGKGGQIEGIGIKTALAVQKYNVDVLGTTYAAPLEQRRGLA

SEQ ID NO: 664 - protein, 1120 aa, Artificial Sequence
  Cas9
MRKVTIGFDIGVSSVGWSVVDMNNGAIVETGVRLFSASSAENNVERRNNRQTRRLNRRRKNRLKDVKYLLETNHFTFDQEQGTNPYELRVAGLHRKLTRSELARALYHLVKRRGISYDLTDIEEEEIVTTSAYKTALGKNQSQLAEKTPGEIQFARLENYGKVRGSIEINEQDILLNIFPTSAYLNEAKRILATQRKFYPEITEAFIEKYCTILTRKREYYVGPGTEKNRTDYGIYRTNGETLDNLFEILIGKDKFYPNEERAAGNSYTAQLFNFVNDLNNLKIQTIEDQKLTPKQKEEIIEQVKTAEKKVSLIQLISKITKTPKDQITGYRTDKNGKPDLHSMAVFRKVRKQFLTMEIDILHWPDELLNDLGRLLTLNTEKGEIRKQLTKDFMKRYPILNEQLVDQIIENRHIFAVSGNHKWHRFSLRTMNELLPEMLATSKEQMTLLSERGMIKQHKRDYLKMNELDARLISEEIYNPVVGKSVREAIKLFNELMKKYQEVRYVVLEMPRDDNEEKAKKELQKYQKENENEKEIALSEFQRKGFFSDAQLERALIKDRKLKTKIRFWHQQEGKCLYSGQIITPVELLTNSFSFDIDHIIPQSVSFDDSLNNKVLCTKEMNDQKGKQTPYGFLLNGNGQGFDRFKAMVNANRLMSKGKKKNLLFMEDLNNIETRKRFIARNLVDTRYASRVVLNEIQQYLRAKNKDTQVAVVRGKFTATLRKHWNINKSRETHHHHALDASIIAITPLLSVWKKKQTLIPKTLSEEKLEFEYDDIVEDTIFEKALYQLPKENFKEQLNNSQPNIKFSYQVDKKMNRKVSDATIYSVKQAKLSSDKQSEEYVLAKIKDIYSVEGYKTFAKIYEKDKSKFLMAQNDPKTFEKLEEIIQSYPSTREIIVGEKVKVVDVSPFELYRKEYGYITKYAKKNNGPIIRQLKYYDHKIGMHLDITNQKNNGKGKKVILQQLKSWRTDVYYNHEKQEYEIMGLKYSDLRFKKDQYGIPKERYQEVKQMEKIAPQSEFCFSLYRNDRIKVLNKETDEEVELLFGARNYTSAGYVDLKPIDRVEFGKKEWIPVYQYATSDGKCKKKFAKKGYEIYKVNTTILGESYYIKKERMLPKNILD

SEQ ID NO: 665 - protein, 1120 aa, Artificial Sequence
  Cas9
MSDLVLGLDIGIGSVGVGILNKVTGEIIHKNSRIFPAAQAENNLVRRTNRQGRRLTRRKKHRRVRLNRLFEEIGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLGNHIDITPKDSNNKVVLQSLKPWRTDVYFNKNTGKYEILGLKYSDMQFEKGTGKYSISKEQYENIKVREGVDENSEFKFTLYKNDLLLLKDSENGEQILLRFTSRNDTSKHYVELKPYNRQKFEGSEYLIKSLGTVVKGGRCIKGLGKSNISIYKVRTDVLGNQHIIKNEGDKPKLDF

SEQ ID NO: 666 - protein, 1120 aa, Artificial Sequence
  Cas9
MGLDIGVASVGFSVLDIDKGKVIELGARLFSATVAAGNQDRRDMRGARRLLNRNKQRRQDTGKLFKKFGLIDDFDKGSFYDNFNQNLNPYELRVKGLTEQLTKEELAESLYQIVKHRGISYALKDADVDEGGTDYSVSLKINSQELAEKTPAQIQLQRLNDYGKVRGQVVIGDDPDNQKVLLNVFPTSAYEKEAKQIIATQQQFYPESLTDKFTEEYCQILTRKRDYFVGPGNEKSRTDYGIYKTDGRTLDNLFEELIGHDKIYPEELRASAASYTAQLFNVLNDLNNLRILNYEDGKLTKEDKEKIIAEIKNNTTTINMLNVIKKVAGCSKDDIKGFRVNEKDKPEISSMPVYRKIHKDLLKAGVDISDWPVEFIDELSFILTLNTENGEIRKQLNNRLAPKFDFLNADLIQLIIDNKDSFEIKTNNKWHRFSVKTMNKLIPEMMERPVEQMTLLNEMGLVKKDKKRFENNKYLPYKEIAKDIFNPVASKSVREALKIVNAVLKKYGHIDYLVVEMPRDKNLKEEQDNIKEFQNKNKKAKDAAFEAFVKSVGSEQRVKEALSKNRKLQMKMRLWYQQQEIDPYNGKTIDATDLINNPDKFEIDHIIPQSISFYDSINNKTLCFASMNQVKGQKTPYEFMLEGHGQSYDKFKATVMANKNFGKAKRANYLFEENVSDIETRKRFLSRNLVDTRYSSRVVLNSLQDFFREKSADTKVTVIRGKFTSNMRKHWHIDKTRETFHHHAIDASIIAATPFLRMWKKGGTIFPVKVGEESIDIETGEILDDKNFDKAMYEEPYSGFVSEIMNADDRIKFSHQVDKKMNRKVSDATIYSTRTGKLAKDKKDAEYIVAKVKDIYSVDGFKKFKKVYDKDKTKFLLYKYDPRTFSKLERIISDCPDKVEKVQTNGKVKAVDISPFEMYRRDHGMIKKYSKKGNGPAIKQLKYLDKKLGSHIDITPANANGKHVILQSLKPWRTDVYLNHETGEYEIMGIKYSDLKFNKNEGYGIKKDKYLEIKKVEEVSEKSEFMFSLYRKDRVKVQDMKTGESVELLFWSRNFSNKKYAELKPISQAENDKKLPVYGKGRLIKRLIPKNCKIWKVNTTILGDPYYLEKESDSPKDILD

SEQ ID NO: 667 - protein, 1121 aa, Artificial Sequence
  Cas9
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSIGDYAQIVKENSKQLETKTPGQIQLERYQTYGQLRGDFTVEKDGKKHRLINVFPTSAYRSEALRILQTQQEFNPQITDEFVNRYLEILTGKRKYYHGPGNEKSRTDYGRYRTNGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKEFVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLGNHIDITPKDSNNKVVLQSVSPWRADVYFNNTTGKYEILGLKYADLQFEKGTGTYKISQEKYNDIKKKEGVDSDSEFKFTLYKNDLLLVKETETKEQQLFRFLSRTMPKQKHYVELKPYDKQKFEGGEALIKVLGNVANGGQCIKGLGKSNISIYKVRTDVLGNQHIIKNEGDKPKLDF

SEQ ID NO: 668 - protein, 1121 aa, Artificial Sequence
  Cas9
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNKQLTNEELFIALKNIVKRRGISYLDDASEDGGTVSSDYGKAVEENRKLLAEQTPGQIQLERFEKYGQLRGDFTVVENGEKCRLINVFSTSAYKKEAERILRKQQEFNSKITDEFIEDYLKILTGKRKYYHGPGNEKSRTDYGRFRKDGTTLDNIFGILIGKCTFYPNEYRASKASYTAQEFNLLNDLNNLSVPTETKKLSEEQKKTIIEYAKSAKTLGASTLLKYIAKMIDTSVDQIRGYRVDVNNKPEMHTFEVYRKMQSLETISVGELSRNVLDELAHILTLNTEREGIEEAINTKLKDSFSQDQVLELVQFRKNNSSLFSKGWHNFSLKLMMELIPELYETSEEQMTILTRLGKQKSKETSKRSKYIDEKELTEEIYNPVVAKSVRQAIKIINEATKKYGIFDNIVIEMARENDEEDAKKDYIKRQKANQDEKNAAMEKAAFQYNGKKELPDNIFHGHKELATKIRLWHQQGEKCLYTGKTIPISDLIHNQYKYEIDHVLPLSLSFDDSLSNKVLVLATANQEKGQRTPFQALDSMDDGWSYREFKSYVKESKLLGNKKKEYLLTEEDISKIEVKQKFIERNLVDNRYSSRVVLNALQDFYKAHKFDTTISVVRGQFTSQLRRKWGLEKSRETYHHHAVDALIIAASSQLRLWKKHNNPLISYKEGRFIDSETGEIISLSDDEYKELVFKAPYDHFVDTLRSKTFEDSILFSYQVDSKYNRKISDATIYATRKAKLDKDKSEETYVLGKIKDIYSQAGYDAFIKIYNKDKSKFLMYHKDPQTFEKVIEEILRTYPSKELNDKNKEIPCNPFEKYRQENGPIRKYSKKGNGPEIKSMKYYDKNIPESFINITPSNSNNKVLLRQLYPWRTDVYFNPQTDKYELLGLKYADLQFEKATGKYSITIDKYNEIKEKEGVSKESEFKFTLYKNDLLLIKDTKNNEEQIFRFLSRTMPNQNHYVELKPYDKGNFEGKEKIKVFKMTSNGRCIKGLGKKYLSIYKVKTDILGNKHFIKKEGDEPKLKF

SEQ ID NO: 669 - protein, 1121 aa, Artificial Sequence
  Cas9
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKRRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFIDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKKYELMGLKYSDLSFEKGSGKYSISNEKYNSIKRIEGVNEQSEFKFTLYKNDLILIKDSENNEQKLFRFNSRNDTAKHYVELKPYDKARFDGQQELITILGNVAKGGQCLKGLNKSNISIFKVKTDVLGKKHIIKKEGDEPKLKF

SEQ ID NO: 670 - protein, 1121 aa, Artificial Sequence
  Cas9
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILKTQQEFNPQITDEFINRYLEILTGKRKYYHGPGNEKSRTDYGRYRTNGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVQKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLGNHIDITPKNSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKKKHYVELKPYDKQKFEGGEALIKVLGNVANSGQCIKGLAKSNISIYKVRTDVLGNQHIIKNEGDKPKLDF

SEQ ID NO: 671 - protein, 1121 aa, Artificial Sequence
  Cas9
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSIGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 672 - protein, 1121 aa, Artificial Sequence
  Cas9
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFVNRYLEILTGKRKYYHGPGNEKSRTDYGRYRTNGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILKRLGKQKTTSSSNKTKYIDEKLLTEEIYNPVVAKSIRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNDPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 673 - protein, 1121 aa, Artificial Sequence
  Cas9
MNGLVLGLDIGIASVGVGILEKNSGKIIHANSRLFPAATADNNVERRKNRQARRLHRRKKHRGVRFQDLFEDYGLLTDFSKVSINLNPYRLRVDGLNQQLTNEELFIALKNIVKRRGISYLDDASEDGGTVSSDYGKAVEENRKLLAEQTPGQIQLERFEKYGQVRGDFTVVENGEKRRLINVFSTSAYRKEAERILRKQQEFNSKITDEFIEDCLKILTGKRKYYHGPGNEKSRTDYGRFRTDGTTLDNIFGILIGKCTFYPDEYRASKASYTAQEFNLLNDLNNLTVPTETKKLSEEQKKVIVEYAKEAKTLGASTLLKYIAKMIDASVDQIRGYRVDVNNKPEIHTFEAYRKMQSLETISVGELSRNVLDELAHILTLNTEREGIEEAINTKLKDSFSQDQVLELVQFRKNNSSLFSKGWHNFSLKLMMELIPELYETSEEQMTILTRLGKQKSKEISKRTKYIDEKELTEEIYNPVVAKSVRQAIKIINEATKKHGIFDNIVIEMARENNEEDAKKDYIKRQKANQDEKNAAMEKAAFQYNGKKELPDSIFHGQKELATKIRLWHQQGEKCLYTGKNIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLIDTRYSSRVVLNALQDFYKAHKFDTTISVVRGQFTSQLRRKWGLEKSRETYHHHAVDALIIAASSQLRLWKKQNNPLIAYKEGQFVDSETGEIISLSDDEYKELVFKAPYDHFVDTLSSKTFEDSILFSYQVDSKFNRKISDATIYATRKAKLDKEKSEETYVLGKIKDIYSQAGYDAFIKIYNKDKSKFLMYHKDPQTFEKVIEEILRTYPSKELNDKNKEIPCNPFEKYRQENGPIRKYSKKSNGPEIKSLKYYDNKLGNHIDITPESSDNQVVLQSLKPWRTDVYFNHQTKKYELMGLKYSDLSFEKGSGKYSISNQKYNSIKRIEGIDEQSEFKFTLYKNDLILIKDSENNEQKLFRFNSRNDTAKHYIELKPYDKAKFDGEQELITILGNVAKGGRCLKGLNKSNISIFKVKTDVLGKKHIIKKEGDEPKLKF

SEQ ID NO: 674 - protein, 1121 aa, Artificial Sequence
  Cas9
MNGLVLGLDIGIASVGVGILNKDTGEIIHTNSRIFPAATADNNVERRNSRQDRRLNRRKKHRGVRLHDLFEDYDLLTDFSKVSINLNPYRLRVQGLDNSLTTEELFIALKNIVKRRGISYLDDASEDGGVVSSDYGKAVEENRKLLAEQTPGQIQLERFKKYGQVRGDFTVVENGEKRRLINVFSTSAYRKEAERILRKQQEFNNQITDKFIEDYLKILTEKRKYYHGPGNEKSRTDYGRFRTDGTTLDNIFGILIGKCTFYPNEYRASKASYTAQEFNLLNDLNNLTVPTETKKLSEEQKKTIVEYAKSAKTLGASTLLKYIAKMIDASVDQIRGYRVDVNNKPEMHTFEVYRKMQSLETISVWELSRNILDELAHILTLNTEREGIEEAINTKLMDVFSQDQVLELVQFRKNNSSLFSKGWHNFSRKLMMELIPELYETSEEQMTILTRLGKQKSKETSKRTKYIDEKEVTEEIYNPVVAKSVRQAIKIINEATKKYGIFDNIVIEMARENNEEDAKKDYIKRQKANQDEKNVAIEKAAFQYNGKKELPDSIFHGHKELATKIRLWHQQGEKCLYTGKNIPISDLIHNQYKYEIDHILPLSLSFDDSLSNKVLVLATANQEKGQRTPFQALDSMDDAWSYREFKSYVKDSKLLGNKKKDYLLTEEDISKIEVKQKFIERNLVDTRYSSRVVLNTLQDFYKAHKFDTTISVVRGQFTSQLRRKWGLEKSRETYHHHAVDALIIAASSQLRLWKKQANPLISYKEDQFVDSETGEIISLTDDKYKELVFKAPYAHFVDTLSSKKFEDSILFSYQVDSKYNRKISDATIYATRKVKLDKDKSEETYVLGKIKDIYSQAGYDAFIKIYNKDKSKFLMYHKDPQTFEKVIEEILRIYPSKEFNEKNKEVPCNPFEKYRQENGPICKYSKKGNGPEIKSLKYYDKNIPESFIDITPSNSKNKVILRQLNPWRTDVYFNHQTEKYELLGLKYADLQFEKKTETYSITIDKYNEIKEKEGVGEHSEFKFTLYKNDLLLIKDMEIKEEQIFRFLSRTMPNKKHYVELKPYYKGNFEGKERIKVFNTTSNGRCLKGLGKKGLSIYKIKTDVLGNKHFIKKEGEKPKLKF

SEQ ID NO: 675 - protein, 1121 aa, Artificial Sequence
  Cas9
MDRTEVNIGFDIGISSVGWSVVATKSGRILESGVSLFSGASAAKNEERRNFRQSRRLLRRRKNRISDLKKYLKEQSFTYNGELLNENPYEIRVKGLTEKLSKEEIALALLHIVKRRGVSYDLGDIEEEGTTGSYKEGVKKNQKLLKEKTPAEIQFQRLKKFHKVRGQIAIDENDVLLNVFPNHAYVDEAQQILYTQQEFYPEINETFINQVTDFISRKRDYFIGPGSEKSRTDYGIYRTDGTTLQNLFSILIGKDKIFPDEFRAAGNSYTAQVYNLLNDLNNLAIDDTETGKLTKQQKEKIIMELKTTEKSVNMMKLIAKTAGVTVEQISRYRINRDGKSEIHNMAVYRKIRKVFLELGYEINEWPSQLLDELGDALSLNTENGEIRRILTDNLANKYKILDQQLINLIIENKNAFTLSTNQKWHRFSYKTMKILIPELLETNKEQMTILTEMGLMKKDQRNYVGKNKIDSEALLENLYNPVVRKSTRQTMKLFNTLLKKYPNIAYVVIEMPREDDEDKARRDYVKFQKDNEKEKDAALKNFIMESGKSEAEVIAKYRQSKKFRSKVRLWYQQMGRCLYSGKAMPAERVFRDDHFTDIDHVIPLSVSFDDGMNNKVLCLAEMNRQKDKQTPYAFFNAGHGQGFQAMNAMLKNNNRISSAKKRNLLFTENLNDLEVRKRFIERNLVDTRYASRVVLNELQQFVKAKQLDTKVTVIRGKFTSKLREKWNINKSRDTHHHHAVDAAVIAVSPMLNLWEKGASIIPNKVGENVIDIKTGEIITDHDYEADVYELPYAKFLEQIPKVKKDIKFRHQVDKKKNRKVSDATIYTTRKAKVGKDKEETDYVLGTIKDIYSLEGYVSFKKIYNKDKAKFLMARIDPKTFEKLEKIVAEYPESIEVVQDNGKVDVQKISPFELYRKDNGFVTKFAKKNNGPAVKSLKYYDSKLGSSIDVTPDNAKNKKVILQSLKPWRTDVYFNEENQEYEIMGLKYSDLKFGKNGKYGVPKVRYEEIKQEEEISEGSKFLFSLYRGDRIKVTNELGENLDLLFSSRTLPAQKGYVELKPIDKTKFDGKEKVSFYGTVTPNGQFVKKFAKKGYKILKLNTDELGNTYIENGEKEPSDILDM

SEQ ID NO: 676 - protein, 1121 aa, Artificial Sequence
  Cas9
MNGLVLGLDIGIGSVGVGILNKDTGEIIHANSRIFPAATADNNVVRRSSRQGRRLNHRKKHRSVRLKDLFEYYDLLTDFSKVSINLNPYRLRVNGLNQQLTNEELFIALKNIVKRRGISYLDDASEDGGAVSSDYGKAVEENRKLLAEQTPGQIQLERFEKYGQVRGDFTVVENGEKRRLINVFSTSAYKKEAERILRKQQEYNNQIMDEFIADYLTILTGKRKYYHGPGNEKSRTDYGRFRTDGTTLDNIFGILIGKCTFYPEKYRASKASYTAQEFNLLNDLNNLTVPTETKKLSEEQKKTIVEYAKSAKTLGASTLLKYIAKMIDASVDQIRGYRVDVKNKPEMHTFEVYRKMQSLETISVGEFSREVLDELAHVLTLNTEREGIEEAINTKLRDSFSQDQILELVQFRKNNSSLFSKGWHNFSLKLMMELIPELYETSEEQMAILTRLGKQKFKETSKRTKYIDEQEVTEEIYNPVVAKSVRQAIKIINEATKKYGIFDNIVIEMARENNEEEAKKDYIKRQKANHDEKNAAMEKAAFQYNGEKELPDSIFHGHKELATKVRLWHQQGEKCLYTGKNIPISDLIHNQYKYEIDHILPLSLSFDDSLSNKVLVLATANQEKGQRTPFQALDSMDDAWSYREFKSYVKDSKSLGNKKKDYLLTEEDISKIEVKQKFIERNLVDTRYSSRVVLNTLQDFYKAHKFDTTISVVRGQFTSQLRRKWGLEKSRETYHHHAVDALIIAASSQLRLWKKQNNPLISYKEGQFVDSETGEIISLTDDEYKELVFKAPYDHFVDTLRSKKFEDSILFSYQVDSKFNRKISDATIYATRKTKLDKDKSEETYVLGKIKDIYSQSGYDAFIKIYNKDKSKFLMYHKDPQTFEKVIEEILRTYPSKEFNEKNKEVSCNPFEKYKQENGPIRKYSKKGNGPEIKSLKYYDKNIPESFINITPSNSKNKVILRQLNPWRTDVYFNHQTEKYELLGLKYADLQFEKKTGTYSITIDKYNEIKEKEGVSEHSEFKFTLYKNDLLLIKDTEIKEEQIFRFLSRTMPNQKHYVELKPYYKGNFEGKERIKVFNTTSNGRCLKGLRKKGLSIYKIKTDVLGNKHFIKKEGEKPKLKF

SEQ ID NO: 677 - protein, 1121 aa, Artificial Sequence
  Cas9
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKEYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASIQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPVNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 678 - protein, 1121 aa, Artificial Sequence
  Cas9
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKCRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKEYELMGLKYSDLSFEKGSGKYSISNEKYNSIKRIEGVNEQSEFKFTLYKNDLILIKDSENNEQKLFRFNSRNDTAKHYVELKPYDKARFDGQQELITILGNVAKGGQCLKGLNKSNISIFKVKTDVLGKKHIIKKEGDEPKLKF

SEQ ID NO: 679 - protein, 1121 aa, Artificial Sequence
  Cas9
MADKTLGALTFGFDIGIASVGWCVLGENRIVDLGVRAFDKAETAKEGESLNLARRTARLMRRRLRRRAWRLTKLARLLKREGLIADAFQMHQPSATSPWKLRVEALDRRLTDDEWARVIYHLCKHRGFHWISRAEEKKAEGDAKGESGRVKKGLSDTQRRMGEKGYRSAAEMVLAEFPEAQRNKQGDYGKALSRVLLSEELALLFRRQRELGHTHASKELEAAILGNGDRKGGLFWAQKPPLAGADLLKMLGKCTFEKDEYRAPKASFTAERHVWLTRLNNLRVVVDGTTRPLTEDERRVALPLPYGYADAKLTYKQLRAALSKAGLSNFSFAGIADDKEKDTLTKLPAWETLSKTLKGKGLETEWEGMAGAATGGDPTLLDEISRVLSVYKDGDEVDVELRKLPLPGGEKMVETLSEISFDKFHALSLKALRKIVPHMETGLRYDEACAAAGYHHSQLHEAGAGGQKYLPPFYTRRDKDGRMVFDEELDVPRNPVVLRALNQARKVLNALVRAYGSPSAVHIEMARDLSKPLVGHPTPNGGYIEGRRDIEKLQKEYRERNEKDKAAFAAEHGIAAKSREFEKFQLYREQQGKCAYSLKPLDLHRVLHDIGYAEVDHALPYSRSYDDGKNNKVLVLTEENRNKGNRTAYEYLCAFPGGENGERWRNFVAYVESNKSYRLAKRTRLLRKDFGGKAAEEFRERNLNDTRYICKFFKNFVERFLQLKVGADGTAAKRCVVLSGQTTAFLRARWGLLKVRGASDRHHALDAAVVAACSHGMVKRLADYSRTKELAKVRDGFPDPETGEIVDPAMFQQLHAHFPDPWPHFRGELEARLQLDDSAELRAQLEMFGTYPAEALETLRPLFVSRAPQRRNGGAAHKETIYAQPERLKEQGGVTQKVSLASLKPTDIDKLIDPHRNEKLYAAIRARLEAHGGKSDKAFPADNPLRKPDRDGNPTGPIVRAVTMVIDKLSGIQIRGGIAKNDTMLRVDVFRHKKDGKFHLVPLYVHHAVAQELPNRAIVAFKDEDEWTLIDDNFHFLFSFHPNDFIRITQKNKAPILGYYASCHRGTGNLNLWAHDRNQKVGKDGQIEGIGVKTAVALEKFHVDVLGNIYPAPPEQRHGLA

SEQ ID NO: 680 - protein, 1121 aa, Artificial Sequence
  Cas9
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 681 - protein, 1121 aa, Artificial Sequence
  Cas9
MNGLVLGLDIGIGSVGVGILNKDTGEIIHANSRIFPAATADNNVVRRSSRQGRRLNHRKKHRSVRLKDLFEYYDLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKRRLINVFSTSAYKKEAERILRKQQEYNNQIMDEFIADYLTILTGKRKYYHGPGNEKSRTDYGRFRTDGTTLDNIFGILIGKCTFYPEEYRASKASYTAQEFNLLNDLNNLTVPTETKKLSEEQKKTIVEYAKSAKTLGASTLLKYIAKMIDASVDQIRGYRVDVNNKPEMHTFEVYRKMQLLETIPVGEFSREVLDELAHILTLNTEREGIEEAINTKLMDVFSQDQILELVQFRKNNSSLFSKGWHNFSLKLMIELIPELYETSEEQMAILTRLGKQKFKETSKRTKYIDEQEVTEEIYNPVVAKSVRQAIKIINEATKKYGIFDNIVIEMARENNEEEAKKDYIKRQKANHDEKNAAMEKAAFQYNGEKELPDSIFHGHKELATKVRLWHQQGEKCLYTGKNIPISDLIHNQYKYEIDHILPLSLSFDDSLSNKVLVLATANQEKGRRTPFQALDSMDDAWSYREFKSYVKDSKSLGNKKKDYLLTEEDISKIEVKQKFIERNLVDTRYSSRVVLNTLQDFYKAHKFDTTISVVRGQFTSQLRRKWGLEKSRETYHHHAVDALIIAASSQLRLWKKQNNPLISYKEGQFVDSETGEIISLTDDEYKELVFKAPYDHFVDTLRSKKFEDSILFSYQVDSKFNRKISDATIYATRKAKLDKDKSEETYVLGKIKDIYSQSGYDAFIKIYNKDKSKFLMYHKDPQTFEKVIEEILRTYPSKEFNEKNKEVSCNPFEKYKQENGPIRKYSKKGNGPEIKSLKYYDKNIPESFINITPSNSKNKVILRQLNPWRTDVYFNHQTEKYELLGLKYADLQFEKKTGTYSITIDKYNEIKEKEGVSEHSEFKFTLYKNDLLLIKDTEIKEEQIFRFLSRTMPNQKHYVELKPYYKGNFEGKERIKVFNTTSNGRCLKGLRKKGLSIYKIKTDVLGNKHFIKKEGEKPKLKF

SEQ ID NO: 682 - protein, 1122 aa, Artificial Sequence
  Cas9
MNGKILGLDIGVASVGVGILDKKTGEIIHASSRIFPAATADSNVERRGFRQGRRLGRRKKHRKVRLADLFSDTGLITDFSKVSINLNPYELRIKGLNEKLTNEELFIALKNIVKRRGISYLDDANEDGESSSSEYGKAVEENRKLLADKTPGQIQLERFEKYGQVRGDFTIEENGEKHRLLNVFSTSAYKKEAERILTKQQDYNQDITDEFIQAYLTILTGKRKYYHGPGNEKSRTDYGRFRTDGTTLDNIFGILIGKCTFYPEEYRAAKASYTAQEFNLLNDLNNLTVPTETKKLSEEQKRQIIEYAKGAKTLGAATLLKYIAKLVDGSVEDIKGYRIDKSEKPEMHTFDIYRKMQTLETVDVEKLSREVLDELAHILTLNTEREGIEEAIKVSFIKREFEQDQIAELVSFRKSNSSLFGKGWHNFSIKLMTELIPELYETSEEQMTILTRLGKQKTKARSKRTKYIDEKELTDEIYNPVVAKSVRQAIKIINLATKKYGVFDNIVIEMARENNEEDAKKDYVKRQKANEDEKNAAMEKAAHQYNGKKELPDNVFHGHKELATKIRLWHQQGEKCLYTGKNIPISDLIHNQYKYEIDHILPLSLSFDDSLANKVLVLATANQEKGQRTPFQALDSMDDAWSYREFKAYVRGARALSNKKKDYLLNEEDINKIEVKQKFIERNLVDTRYSSRVVLNALQDFYKLNDFDTKISVVRGQFTSQLRRKWRIDKSRETYHHHAVDALIIAASSQLRLWKKQGNPLISYKENQFVDSETGEIISLTDDEYKELVFRAPYDHFVDTVSSKKFEDRILFSYQVDSKYNRKISDATIYSTRKAKLGKDKSEETYVLGKIKDIYTQTGYDAFIKLYKKDKSKFLMYHKDPITFEKVIEEILKTYPDKEINEKGKEVACNPFEKYRQENGPLRKYSKKGKGPEIKSLKYYDNKLGNHIDITPDNSENQVILQSLKPWRTDVYFNHKTKIYELMGLKYSDLSFEKGSGKYRISLDKYNVIKKKEGVHKESEFKFTLYKNDLILIKDLEKSEQQLFRYNSRNDTSKHYVELKPYDKAKFEGNQPLMALFGNVAKGGQCLKGLNKANISIYKVQTDVLGNKRFIKKEGDAPKLEF

SEQ ID NO: 683 - protein, 1122 aa, Artificial Sequence
  Cas9
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTNGETLDNIFGILIGKCTFYPDEFRAAKASYTAQEFNLLNDLNNLTVPTETKKLSKEQKNQIINYVKNEKVMGPAKLFKYIAKLLSCDVADIKGHRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 684 - protein, 1122 aa, Artificial Sequence
  Cas9
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHIFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWGEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 685 - protein, 1122 aa, Artificial Sequence
  Cas9
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWGEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 686 - protein, 1123 aa, Artificial Sequence
  Cas9
MAKILGLDLGTNSIGWALIDDVQNKILGVGSRIFPMGVENLGDGDGEISKNASRTGTRGVRRQFFRRRLRKKVLLKALSENNMCPMITSDFDNWKKTKQFPSEKLASWFALNPYELRNKALSEKLTLEEIGRIFYHLIQRRGFLSNSRKGGTDDGAIFKGNPKEGKIGITDTQESIQDKTLGSYLFEIYPKENQPFQNGLERIRNRYTVRKMYVDEFEMIWEKQAQYYSNLNEDLKTLFGGRKLDGYKEDGILFHQRPLRSQKHLVGNCVFEPNKTKCPISAIPFEQFRVWQWVNTVEYNGKKISQVEKEKIVEFLYANDKTDFKKIRKAIGKESTEFKFNYKDDDKIVGTYTVSHLSNKKYFGKKWFEFSEKEQEDIWHILYFFDSKSNLKEYAIKNWNFTEEQAESIAKFNVKDGYSSLSRKAISNILPFLKLGFTYDVAVVLGGIKNVFGHEWEKLSDEKRNFLIDNVEGIVRSKTKGGFIDVIKDILRNDYNISDNQLRKLYHHSATIYVAELLEKLPVGKEADKEIQSIRNPIVITALFELRKLVNELIDDFGSIDEIKVEMARDLKISKSQRNKIRREQKRLERENDRVKARLLEEGQRITHDNILLYKLWEECKKTCPYTGNPIPLYKLFTGEIQIEHIHPWSRSLNDSFANKTLCYADENRKKGDKTPYEFYGNDESNWSAIKERALKLFSDTKEYPNAYQKFKRFVQHKFDDDFSSRQLNDTRYISKEAKNYLSKICKKVAVSPGQATSNLRQKWGMNNILNDENEKTREDHRHHAIDALVMACTKISYVQELSKWNRYNRNAELKKFPLPWETFWSDANRAVDKILISHKKVSNDITGRTHISEKNGKKYKNVGVAARGQLHKETVYGKRTFNGEEAFHVRKTIDSLTTEKQLEKVVDESIKLLIKKRVQELGGFVKGAIPANTFFVVDENGIKQPQIFLPNKNGAPVPVLKVRMKENIGGAEKLKENVNQWVNPRNNHHVLIYKDEKGNLKEEVVTFWTVVERKRTGQSAYQLPFDGKEIVTTLHINDMFLLGLNEEEINWENPDYEVLKEHLYRVQKFTSGDYYFRIAKTSSIQNAIEKQQINSFGFGKNGWSTHNPIKVKISVSGKISKV

SEQ ID NO: 687 - protein, 1123 aa, Artificial Sequence
  Cas9
MNGLVLGLDIGIGSVGVGILNKDTGEIIHTNSRIFPAATADNNVERRNSRQARRLNRRKKHRGARLHDLFEDYDLLIDFSKVSINLNPYRLRVQGLDNPLTTEELFIALKNIVKRRGISYLDDASENGGAVSSDYGKAVEENRKLLAEQTPGQIQLERFEKYGQVRGDFTVEEKGDKHRLINVFSTSAYRKEAERILRKQQEFNNQITDKFIEDYLKILTEKRKYYHGPGNEKSRTDYGRFRTDGTTLDNIFGILIGKCTFYPNEYRASKASYTAQEFNLLNDLNNLTVPTETKKLSEEQKKTIVEYAKSAKTLGASTLLKYIAKMIDASVDQIRGYRVDVNNKPEMHTFEVYRKMQSLETIPVGEFSREVLDELAHILTLNTEREGIEEAINTKLMDVFSQDQILELVQFRKNNSSLFSKGWHNFSLKLMMELIPELYETSEEQMAILTRLGKQKFKETSKRTKYIDEKEVTEEIYNPVVAKSVRQAIKIINEATKKYGIFDNIVIEMARENNEEDAKKDYIKRQKANHDEKNAAMEKAAFQYNGKKELPDSIFHGHKELATKIRLWHQQGEKCLYTGKNIPISDLIHNQYKYEIDHILPLSLSFDDSLSNKVLVLATANQEKGQRTPFQALDSMDDAWSYREFKSYVKDSKLLGNKKKDYLLTEEDISKIEVKQKFIERNLVDTRYSSRVVLNTLQDFYKAHKFDTTISVVRGQFTSQLRRKWGLEKSRETYHHHAVDALIIAASSQLRLWKKQANPLISYKEDQFVDSETGEIISLTDDKYKELVFKAPYAHFVDTLSSKKFEDSILFSYQVDSKYNRKISDATIYATRKVKLDKDKSEETYVLGKIKDIYSQAGYDAFIKIYNKDKSKFLMYHKDPQTFEKVIEEILRTYPSKEFNEKNKEVPCNPFEKYRQENGPIRKYSKKGNGPEIKSLKYYDKNIPESFINITPSNSKNKVILRQLNPWRTDVYFNHQTEKYELLGLKYADLQFEKKTGTYSITIDKYNEIKEKEGVGEQSEFKFTLYKNDLLLIKDTKNNEKQIFRFLSRTMPNVKHYVELKPYDKAKFDGNQPLITIFGNVAKGGQCLKGLNKSNISIFKVKTDVLGNKHFITKEGEKPKLKF

SEQ ID NO: 688 - protein, 1125 aa, Artificial Sequence
  Cas9
MNGLVLGLDIGIASVGVGILNKETGEIIHVNSRIFPAATADSNVERRGFRQGRRLGRRKKHRSARLNDLFEEFGFITDFSAVPLNLNPYALRVKGLSEELTNEELFIALKNIIKRRGISYLDDASEDGETASNEYGKAVEENRKLLADKTPGQIQLERFEKYGQVRGDFTVVENGENHRLINVFSTSAYKKEAERILRRQQEFNVRISDEFIEAYLTILTGKRKYYHGPGNEKSRTDYGRFRTDGTTLDNIFGILIGKCTFYPDEYRAAKASYTAQEFNLLNDLNNLTVPTETKKLRPEQKRQIVEYARTAKTLGTPTLLKYIAKLVDGSIDDIKGYRIDKSDKPEMHTFDAYRKMRTLELVDVDILSRETLDDLAYILTLNTESEGILEALNSKMPGTFTKEQIDELIQFRKKNSAVFGKGWHNFSLKLMNELIPELYETSEEQMTILTRLGKQRSREISKRTKYIDEKELTDEIYNPVVAKSVRQAIKIINLATKKYGIFDNIVIEMARESNEDDEKKAIQNVQKANEDEKKAAMEKAADLYNGKKELPDSIFHGHKELATKIRLWHQQGERCLYTGKNISIHDLIHNPHQYEIDHILPLSLSFDDGLANKVLVLATANQEKGQRTPFQALDSMDDAWSYIEFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYREGQLVDPETGEILSLTDDEYKELVLRPPYDYFVDTLKSKSFEDSILFSYQVDSKYNRKISDATIYGTRKAQLGKDKQEETYVLGKIKDIYSQKGYEDFIKRYKKDTTQFLMYHKDPQTFAKVIEEILKTYPDKELNEKGKEIPCNPFEKYRQENGPIRKYSKKGKGPEIKSLKYYDNKLGNHIDITPVNSQNQVVLQSLKPWRTDVYFNPQTSKYELMGLKYSDLRFEKGSGSYGISPEKYNKVKAKEGVDEDSEFKFTLYKNDLILIKDTETGEQQLFRYGSRNDTSKHYVELKPYEKAKFEGNQQLMNLLGTVAKGGQCLKGINKPNLSIYKVKTDVLGNKYFIKKEGDQPQLNFKKKI

SEQ ID NO: 689 - protein, 1125 aa, Artificial Sequence
  Cas9
MTSKQENLGALTFGLDIGIASVGWAVLGENRIIDLGVRCFDKAETAKEGESLNLARRMARLLRRRLRRRAWRLTKLARLLKREGLIADANLFKNKIEKNTPVPKSSWQLRVDALDRKLNAEEWARVIYHLCKHRGFHWISRAEEKAAESDSKGESGKVKQGLAGTKKLMQEKNYRTAAEMVLAEFPEAQRNKQGDYSKALSRILLGDELKTLFEHQRKLDSPFATEKLEAAILGNGDRKSGLFWAQNPALAGSDLLKMLGYCTFEKTEYRAPKASFTAERHVWLTRLNNLRIVVDGTTRPLNEAERRIALLMPYQQAGDFTYKQLRTALTKAGFLPESFRYTGLSYASGQKAGEKTKDPESAALVKFPAWQELRKTLEKKELASEWQKISTDALDGKPQLLDQIAWVLSVYKDDDEVKAELSKLNLPNAEKMIDALLDIRFDKFSNLSLKALCKIVPLMEQGQRYDEAIANIPEYGHHSQLHKVGAGEHKYLPPFYKERDKTGRMVFNDDMDIPRNPVVLRALNQARKVVNALIKKYDSPHEVHIEMARDLSRPLDERREVEKLQKEFRDNNEKGKAQFAQDFNIVGAVKGKEFEKYQLYREQQGKCAYSIEPMDIHRLFEQGYVEIDHALPYSRSFDDSKNNRVLVLAKENRDKGNRTPFEYLGGKDNSEPWRQFVAFVEGNKAYRLAKRSRLLRKDFGDKEAKEFRERNLNDTRYICKFFKNYVEQYLQLHEDSEAKRCVVLSGQMTSFLRARWGLVKVRGDSDRHHALDAAVVAACSHGMVKRLSDYSRRKELEQVREGFVDVDTGEIVNPAMFQQVQEHFPNPWPHFRDEVKLRLSMDDPALLRSEMEKFGTYTPEALQALHPLFVSRAPQRRNSGAAHKDTIYAQPKRLVAQGGVTQKVALTSLTLKDLDKLIDPHRNDKLYTAIRARLEQHGGKGDKAFPSSNPLRKPDSEGNPTGPIVRGVTMVIDKLSGIPIRGGIAKNDSMVRVDVFTKANKFHLVPVYVHHTVAKALPNRAVVAFKDEDEWTLIDDSFDFCFSLHPNDLVQVQQKGKAGMIGYYSSCHRGTGNINLWAHDRNLQVGKDGMIEGIGVKTALSLEKFNVDVLGNRYPAPPEKRRDLA

SEQ ID NO: 690 - protein, 1125 aa, Artificial Sequence
  Cas9
MTDRISLGLDIGVASVGFSVLDIDKGKVIELGARLFNATVAAGNQDRRDMRGSRRLLNRNKQRRKDVSKLFQEYGLLDNFDRDNFHTAFNNNWNPYELRVKGLTKQLNKEELADSLYQIIKRRGISYALKDADANEDGTDYSSSLKINSQELIEKTPAQIQLQRLNDYGKVRGKVIVGDDIDDQKVLLNVFPTNAYEKEARQIIATQQQFYPEILTGEFVKEYCQILTRKRDYFVGPGNEKSRTDYGIYKTDGRTLDNLFEELIGHDKIYPDELRASAASYTAQLFNVLNDLNNLRILSYEDGKLTQIDKEKIIAEIKNNTTVVNMLNVIKKVTGCQKDDIKGFRLNEKDKPEISSMPIYRKAHKDFLKVGIDITDWPIDFIDRLSFILTLNTENGEIRKQINKRLVPDFDFLNDDLVQLIIDNKDSFDIKTNNKWHRFSLKTMNKLIPTMIERPVEQMTLLTEMGLIKKDTKRFEGNKYLPYKEIANDIFNPVASKSVREALKIVNAVLKKYGHIEYIVIEMPRDKNLDEERKQIADFQKKNKKIKDAAFNAFVKAVGSKKNVKIALSKNRKLQMGIRLWHQQQGIDPYNGEEINANDLISNPDKFEIDHIIPQSISFDDGINNKTLCFASMNQVKGQKTPYEFLNEGHGQGYAKFKAIVSKNKNFSKAKRDNYLFEENVSNIETRKRFLSRNLVDTRYSSRVVLNSLQEFFHEKSDDTKVTVIRGKFTSNMRKHWHIDKTRDTFHHHAIDASIIAATPFLRMWKKGSTIFPTKINETSIDIETGEILDDKNFDKVMYEEPYSGFISEIMNADDRIKFSHQVDKKMNRKVSDATIYSTRIGKLSKDKKDAEYVVAKVKDIYSVDGYENFKKVYKKDKTKFLLYKYDPRTFSELEKIVIDYPDKIEKVQTNGKIKAVDISPFELYRRDNGMVRKYSKKTGPAIKQLKYLDKKLGSHIDITPKNANNKHVVLQSLKPWRTDVYLNHETGEYEIMGIKYSDLKFNKNEGYGIKKDKYLKIKNIEGVSENSEFMFSLYRKDRIKVQDMETNESVELLFWSRNFSNKKYAELKPISQIDNDKVLPIYGRGRLIKRLIPKNCKIWKVNTSILGDTYYLEKESNYPQKILD

SEQ ID NO: 691 - protein, 1126 aa, Artificial Sequence
  Cas9
MNGLVLGLDIGIASVGVGILNKETGEIIHANSRIFPAATADSNVERRGFRQGRRLGRRKKHRSARLNNLFEEFGFITDFSAIPLNLNPYALRVKGLSEELTNEELFIALKNIIKRRGISYLDDASEDGETASNEYGKAVEENRKLLADKTPGQIQLERFEKYGQVRGDFTVVENGENHRLINVFSTSAYKKEAERILRRQQEFNVRISDEFIEAYLTILTGKRKYYHGPGNEKSRTDYGRFRTDGTTLDNIFGILIGKCTFYPDEYRAAKASYTAQEFNLLNDLNNLTVPTETKKLSPEQKRQIVEYARTAKTLGTPTLLKYIAKLVDGSIDDIKGYRIDKSDKPEMMHTFDAYRKMRTLDLVNIDALSRETLDDLAHILTLNTESEGILEALNSKMPSTFTKEQIDELIQFRKKNSAVFGKGWHNFSLKLMNELISELYETSEEQMTILTRLGKQRSREISKRTKYIDEKELTEEIYNPVVAKSVRQAIKIINEATKRYGIFDNIVIEMARENNEEDAKKDYIKRQKANQDEKNASMEKAAFQYNGKKELPDSIFHGHKELATKIRLWHQQGERCLYTGKNISIRDLIHNPHQYEIDHILPLSLSFDDGLANKVLVLATANQEKGQRTPFQAIDSMDDAWSYREFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYKEGQFVDPETGEILSLTDDEYKELVFRPPYDYFVDTLKSKSFEDSILFSYQVDSKYNRKISDATIYGTRKAQLGKDKQEETYVLGKIKDIYSQKGYEDFIKRYNKDETQFLIYHKDPQTFEKVIEEILKTYPDKELNEKGKEIPCNPFEKYRQENGPIRKYSKKGKGPEIKILKYYDNKLGNHIDITPVNSQNQVVLQSLKPWRTDVYFNPRTSKYELMGLKYSDLRFEKGSGSYGISPEKYNKVKAKEGVNEDSEFKFTLYKNDLILIKDTETGEQQLFRYGSRNDTSKHYVELKPYEKAKFEGNQQLMNLLGTVAKGGQCLKGINKPNLSIYKVKTDVLGNKYFIKKEGDQPQLNFKKKF

SEQ ID NO: 692 - protein, 1126 aa, Artificial Sequence
  Cas9
MASKHENLGALTFGLDIGIASVGWAVLGENRIIDLGVRCFDKAETAKEGESLNLARRTARLLRRRLRRRAWRLTKLARLLKREGLIADTNVFQKPFNLKDANEKGLSFWQLRVDALDRKLSAEEWARVIYHLCKHRGFHWISRAEEKAAEGDSKSEGGKVKQGLAGTKKLMQEKNYRTAAEMVLTEFPEAQRNKQGDYSKALSRILLGDEMTQLFKHQRELGNPHATEKLEAAILGNGDHKSGLFWAQNPALAGNDLLKMLGHCTFEKAEYRVPKASFTAERHVWLTRLNNLRIVVDGTTRPLNEAERHLALLMPYQQAGDLTYKQLRTALTKAGYLPESFRYTGLAYASGQKADEKAKDPESAPLVKLPAWHELRKTLEKKELASEWQKISSDALDGKPQLLDQIAWVLSVYKDDTEVEAELCKLNLPNAEKMIDALLDIRFDKFSNLSLKALRQIVPLMEQGQRYDEAVANIPEYGHHSQLHEVGAGEHKYLPPFYKERDKTGRMVFNDDMDIPRNPVVLRALNQARKVVNALIKEYGSPHEVHIEMARDLSRPLDERRDVEKLQKEFRDRNEKDKALFAQDFNIVGAVKGKEFEKYQLYREQQGKCAYSIEPMDIHRLFEQGYVEIDHALPYSRSFDDSKNNRVLVLAKENRDKGNRTPFEYLGGKDNSERWRQFVAFVEGNKSYRLAKRSRLLRKDFGKDEAKGFRERNLNDTRYICRFFKNYVEQYLQLHEDSDAKRCVVLSGQMTSFLRARWGLVKVRGDSDRHHALDGAIVAACSHSMVKRLSDYSRRKELEQVRAGFVDVDTGEIVNPAMFQQVQEHFPNPWPHFRDEVKLRLNVDDPALLHSEMNRFGTYSPEALKALRPLFISRAPQRRNSGAAHKDTIYAQPERLVAQGGVTQKVPLTSLTLKDLDKLIDPHRNEKLYSAIRIRLEQHGGKGDKAFPASNPLRKPDSEGNPTGPIVRGVTMVIDKLSGIPIRGGIAKNDSMVRVDVFTKAGKFHLVPVYVHHAVAKVLPNRAVVAYKDETEWTLIDDGFDFCFSMYPNDLLRIKLRNASHLGYYASCNRSTGAINLWSHDRNQQVGKDGMIESIGVKTALNVEKLNIDVLGNRYPAPPEKRRDLA

SEQ ID NO: 693 - protein, 1127 aa, Artificial Sequence
  Cas9
MSDLVLGLDIGIGSVGVGILNKVTGEIIHKNSRIFPAAQAENNVERRINRQGRRLTRRKKHRRVRLNHLFEESGLITDFTNVSINLNPYQLRVKGLTDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNPQITDEFINSYLQILTGKRKYYHGPGNEKSRTDYGRYTTKKDSEDEYITLDNIFGILIGKCTFYPEEYRAAKASYTAQEFNLLNDLNNLTVPTETKKLSEEQKNQIITNVKNEKAMGPAKLFKYIAKLLSCDVADIKGYRIDKSDKAEIHTFEAYRKMKTLATIDIEQMERENLDKLAYVLTLNTEKEGIQEALEHEFADGTFSQEQIDELVQFRKANSSIFGKGWHSFSVKLMMELIPELYATSEEQMTILTRLGKQKTTSSSNKTKYIDEKQLTEEIYNPVAAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEIDHILPLSITFDDSLANKVLVYATANQEKGQRTPYQALDSMDDAWSFRELKAFVRDSKALSNKKKEYLLTEEDISKFDVRKKFIERNLVDTRYASRVVLNALQEHFRVHKTDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYSQTGYDAFIKIYKKDKSKFLMYRHDPQTFEKVIEPILENYPNKELNEKGKEVPCNPFLKYKEDHGYIRKYSKKGNGPEIKSLKYYDSKLGNHIDITPKNSNNKVVLQSVSPWRADVYFNKTTGKYEILGLKYADLKFEKGTGTYKISEEKYNDIKIKEGVDSDSEFKFTLYKNDLLLIKDTETKEQQLFRFLSRTMPNVKHYVELKPYDKQKFDDNEELIKILGIVAKGGQCKKGVSKPNISIYKIRTDVLGNQHIIKNEGDKPKLDF

SEQ ID NO: 694 - protein, 1127 aa, Artificial Sequence
  Cas9
MNGLVLGLDIGIASVGVGILEKDSGKIIHANSRIFPAATADNNVERRTSRQARRLNRRKKHRSVRLHDLFEEYGLLTDFSKVSINLNPYQIRVQGLDKRLTNEELFIALKNIVKRRGISYLDDASEDGGAVSSDYGKAVEENRKLLAQQTPGQIQLDRFEKYGQVRGDFTVVENGEKRRLINVFSTSAYRKEAERILRKQQEFNNKITEGFIEDYLTILTGKRKYYHGPGNEKSRTDYGRYTTKKDSQGEYITLDNIFGILIGKCTFYPDEYRASKASYTAQEFNLLNDLNNLTVPTETKKLSVEQKKTIVEYAKTAKTLGASTLLKYIAKLIGVSVDQIHGYRIDPNEKPEMHTFEVYRKMQSLETIRVEELPRKVIDELAHILTLNTEREGIEEAINAKLKDIFSQDQVLELVQFRKNNSSLFSKGWHNFSLKLMMELIPELYETSEEQMTILTRLGKQKSKETSKRTKYIDEKELTEEIYNPVVAKSVRQAIKIINEATKRYGIFDNIVIEMARENNEEDAKKEYIKRQKANLDEKNAAMEKAAFQYNGKKELPDNVFHGHKELATKIRLWHQQGEKCLYTGKNIPISDLIQNRYKYEIDHILPLSLSFDDSLSNKVLVLATANQEKGQRTPFQALDSMDYAWSYREFKSYVKDSKLLSNKKKDYLLTEEDISKIEVKQKFIERNLVDTRYSSRVVLNALQDFYKEHQFDTTISVVRGQFTSQLRRKWGIEKSRETYHHHAVDALIIAASSQLRLWKKHNNPLISYKEEQFVDSETGEIISMSDDEYKELVFKAPYDHFVDTLKSKKFEDSILFSYQVDSKYNRKISDATIYATRKAKLDKDKSEETYVLGKIKDIYSQAGYDTFIKIYNKDKSRFLMYHKDPQTFEKVIEEILRTYPSKELNEKNKEVPCNPFEKYRQENGPIRKYSRKGNGPEIKSLKYYDNKLGNHIDITPNESMNQVVLQSLKPWRTDVFFNHQTEKYELMGLKYSDLNFEKGSGKYSISLEKYNSIKMNEGVSEESEFKFTLYKNDLILIKDALTKEAQIFRYGSRNDTSKHYVELKPYDMSKFEGDERLIKVLGTVAKGGRCIKGLNKKDISIFKVKTDVLGNKHFIKKEGEEPKLKF

SEQ ID NO: 695 - protein, 1128 aa, Artificial Sequence
  Cas9
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKDIQLIFMGAISERTRPILPL

SEQ ID NO: 696 - protein, 1128 aa, Artificial Sequence
  Cas9
MDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRIGCSWSEKGYILTPRNKAENYQHTMLRAMLVEEVKEIFSSQRRLGNKKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTANKPYSEWRTMEDKDFLFSLYSRDLVHIKSKKGIPIKNVDGSLGESKEVYAYYIGADISGAKIEGKAHDSRYTFRGIGVQKLELIEKCQVDILGHISTVKNEKRMGFS

SEQ ID NO: 697 - protein, 1128 aa, Artificial Sequence
  Cas9
MNDKNQKYRLGLDLGTNSIGWCIYSLDVNNKPETLIDMGVRIFSDGRDPKTKEPLAVERRTARGLRRILHRRKLRRRQMFRLLQEQGLMPNDASEAAALKSLNPYELRVKALDTKLEPYELGRALFNLSVRRGFKSNRKEAVQEKEKDSQNDAKSQNEKCEHLAKAIKDSGCRTLGEFLWKHKNTETQQTENDARNIGMRFVPGRSNYYPTRRMYVEEFDAIRKAQEPYYSGVNWDALHEKLFYQRPLRAQERGKCRYMPDKERTFKAMPCSQKIRILQEVYNMDYIDEYGKTIPLEEAQTDSLISLLDKREKLSFKAMKKELGIDESCTFNLERGGREYLQGNAAAVKLRNKKRFGELWDSLSLAKQDAIVEKLITADEDAEIISMLAQYNLTDEQKKNIAVTVLPSGTAMLCKEVTEMLVQKMEQNKIPLTVAVQMLGYTYADQSVREEDTLPYYGAILTGSTMGAHPEADESEPELKYGKISNPTVHVALNQTRTVVNALIKAYGKPQQIVVELSRDLKASREAKARIQKTITMNQKRNERDNKNITDITKIPYPNRNDRLKYRLWEELGSGSNSFSRKCLYCGKPISGSEIFTENIEIEHILPFGRTLFDGETNKTVAHTDCNRDKGDRSPFEAFGSSPNGYNWHEICARANSLKNPAKRTLFAENAMEKFEKDNSFIQRQLTDNAYLSRSALRYLRCICKDVWSINGGMTKLLRDKWNIDSILKRKIDDPEIAHFELKNDQIGQYKKNRYDHRHHALDASVIALIDRAMVQEISQLNKIRLKNRIEAPQMPVLRSELIEKVKHITVSFKPDHGRQGKLSKETLLGKIKKIEKVDIDSIQTDDIASIKDDAIRTRFETKRRELGDITKAKAALKTEFPKLDVFKTYYVSRTPIVSLTEKNINSIVDEKIKEKLKTFIKEHADLSFAEQLQKFSETEWIGKPSAAGKPGKKYRIEKVRCINWGQTPITITSSAVPRYLCPEDYLAAVVWQIPSKKKDTEPEYKATFLRRDEFDVNNKPKKLEKPHDAAQYICMLYKDDYLEFTESGATHLCRIAGLPASQNNKIDIRPIYAVSDCKDWIIATNENMLEPCWKPQKEEKRISVNVLFGKHKARSVTVNPIGRVFRK

SEQ ID NO: 698 - protein, 1128 aa, Artificial Sequence
  Cas9
MSDLVLGLDIGIGSVGVGILNKVTGEIIHKNSRIFPAAQAENNVERRTNRQGRRLTRRKKHRRVRLNHLFEESGLITDFTKVSINLNPYQLRVKGLIDELSNEELFIALKNMVKHRGISYLDDASDDGNSSVGDYAQIVKENSKQLETKTPGQIQLERYQKYGQLRGDFTVEEDGKKHRLINVFPTSAYRSEALRILQTQKEFNPQITDEFINRYLEILTGKRKYYHGPGNEKSRTDYGRYTTKKDSENEYITLDNIFGILIGKCTFYPEEYRAAKASYTAQEFNLLNDLNNLTVPTETKKLSEEQKNQIINYVKNEKAMGPAKLFKYIAKLLSCDVADIKGYRIDKSDKAEIHTFEAYRKMKTLETIDFEKMSRDQLDKLAYVLTLNTEREGIQEALDHEFADGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGRAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKSLSNKKKEYLLTEEDISRFDVRKKFIERNLVDTRYASRVVLNALQEHFRAHKTDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRQAKVGKDKKDETYVLGKIKDIYSQTGYDAFIKIYQKDKSKFLMYRHDPQTFEKVIEPILENYPNKEMNEKGKEVPCNPFLKYKEEHGDYIRKYSKKGNGPEIKSLKYYDSKLGNHIDITPKDSNNKVVLQSVSPWRADVYFNKTTGKYEILGLKYADLQFEKGTGTYKISQEKYNVIKKKEGVDSDSEFKFTLYKNDLLLIKDTETKEQQLFRFLSRTKPNVKHYVELKPYDKQKFEGNESLINVLGAVAKGGQCQKGINKPNISIYKVRTDVLGNQHIIKNEGDKPKLDF

SEQ ID NO: 699 - protein, 1128 aa, Artificial Sequence
  Cas9
MDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRTGCSWSEKGYILTPRNKAENYQHTMLRAMLVEEVKEIFSSQRRLGNEKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGTILTCYKNDDSRTERLAKLGLVPIEMEGLLAYTPTKFQHLSMKAMRNIIPFLEKGMTYDKACEEAGYDFKADSKGIKQKLLTGEKVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFHVNGKYYFVPVYTADVVKKVLPNRAATAHKPYGEWKVMEDKDFLFSLYSRDLIHIKSKKDIPIKMVNGGMEGIKETYAYYIGADISAANIQGIAHDSRYKFRGLGIQSLDVLEKCQIDVLGHVSVVRSEKRMGFS

SEQ ID NO: 700 - protein, 1128 aa, Artificial Sequence
  Cas9
MSDLVLGLDIGIGSVGVGILNKVTGEIVHKNARIFPAAQAENNVERRTNRQGRRLTRRKKHRRVRLNHIFEESGLITDFTKVSINLNPYQLRVKGLTDELSNEELFIALKNMVKHRGISYLDDASDDGNSSVGDYAQIVKENSKQLETKTPGQIQLERYQKYGQLRGDFTIEEDGKKHRLINVFPTSAYRAEALRILQTQQEFNPQITDEFINSYLQILTGKRKYYHGPGNEKSRTDYGRYTTKKDSEDEYITLDNIFGILIGKCTFYPEEYRAAKASYTAQEFNLLNDLNNLTVPTETKKLSEEQKNQIITYVKNEKAMGPAKLFKYIAKLLACDVADIKGYRIDKSDKPEIHTFEAYRKMKTLETIDVEQMEREKLDKLAYVLTLNTEREGIQEAIEHEFSDGTFSQEQVDELVQFRKSNSSIFGKGWHNFSVKLMMELIPELYATSEEQMTILTRLGKQKRTSSSNKTKYIDEKRLTEEIYNPVVAKSVRQAIKIVNAAIKEYGDFDNIVIEMAREMNEDDEKKAIKKIQEANKSEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRARKIDTKVSVVRGQFTSQLRRHWGIDKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYSQAGYDAFIKIYQKDKSKFLMYRHDPQTFEKVIEPILENYPNKEMNEKGKEVPCNPFLKYKEEHGDYIRKYSKKGNGPEIKSLKYYDSKLGNHIDITPKNSNNKVVLQSVSPWRADVYFNKTTGKYEILGLKYADLQFEKGTGTYKISQEKYNDIKKKEGVDSDSEFKFTLYKNDLLLIKDTETKEQQLFRFLSRSMPNKKHYVELKPYSKDKFEKNETLIEILGPTDKSGRCIKGLAKSNLSIFKVRTDILGNQHIIKNEGDKPKLDF

SEQ ID NO: 701 - protein, 1128 aa, Artificial Sequence
  Cas9
MTKILGLDLGTNSIGWAVVDEKKEKILGMGSRIFPEGVVNIGEGEGRETSKNASRTDARGTRRQFFRRRLRKRYLLRELAKKGLCPINYTLVKEWNEAQIFKNKQLQEWFKLNPYELRSKAIQEKISLEELGRIFYHFIQRRGFQSNSRSAGVDNIEKSVIFKGDTKTGKIGISETLESIKNTKTLGSYLHTIYPKQNKPYSGHKERIRNRYTTRQMYIYEFETIWEYQKQFYSELSNELKTVLGGRKKDGYKEDGILFHQRPLRSQKHLVGYCSFEPKKTKCQINTIPFELFRIYQWVNTVDCNEKVTSEDRGKMVELLLSKEKVSFKEIRKVINKSDGYYQFNYKNDDKIVGSYTISNLSNKKFFGKKWFDFSDKEQEDIWHVLSFFDDRDKLKQYAIKYWGFNEEKAVKISKFNLKEGYSNLSRKAIHNILPFLKLGFMYDVAVGLGGVKNALADKWIENEQFILDNVPSVVRSNFKGGYIEPLKQMLKYEFDVSDKQLLKLYHHSSAIETTELLKKLPINSEADKEIQSIKNPVVITALFEIRKLVNEIIDTYGKFDEIKVELARDLKASKSKRYDTRREQLRLEKENDRIKIELENLGQRINHITILKYKLWEECDKRCPFTGKNIEVNELFSGEVQIEHIFPWSRSLNDSFMNKTLCFADENRAKGNKTPYEFYSEQGEQKWEEIKIQALSCFKNKPNYPNAYQKFKQFVKKKHDEDFISRQLNDTRYISKEAKNYLSKICNNVQVAPGQMTATLRHKWGLNTILNKDDDTKTRDDHRHHAIDALVMACSTRSHLQELSKRNRYQKDYEFKDFPMPWQFFRQDAEKSVEQILVSHKKLNTILTVRTHKTKKNGVVYKNIGVAARGQLHKETVFGKRTAPDGIEAYHVRKPIESLSTHKHINKVVDETIRLLILKQVNKLGGFVKGKIPEGTFYNTDENGNKQPQIFLPNKNGNPVPIKKIRLRENIGGAEQLKSTVNQHVNPRSNHHVLIYKDFDDNLKEKVVTFWTAVERKKQKQAVFQLPENGKEIVTTLQINDMFLLGLKDDEINWEHPKFTLLKEHLYRVQKFTSGDYYFRKHIESNLNGELGKAYQYIKGFGEGKTGWKTFNPIKIKVSVSGKIEKV

SEQ ID NO: 702 - protein, 1129 aa, Artificial Sequence
  Cas9
MNGLVLGLDIGIASVGAGILKKDTGEIIHANSRLFPAATADNNVLRRSSRQARRSTRRKRHRAVRLHDLFEDYGLLTDFSKVSINLNPYKLRVEGMDIQLTTEELFIALKNIIKRRGISYLDDASEDGVTVSSDYGKAVEENRKLLSEQTPGQIQLERFEKYGQVRGDFTVEENGEKRRLINVFSTSTYRKEAERILRKQQEFNNKITDDFIDDYLTILTGKRKYYHGPGNKKSRTDYGRYTTKKDSEGKYITLDNIFGVLIGKCTFYPDEYRASKASYTAQEFNLLNDLNNLTVPTETKKLSEKQKKTIVEYAKTAKTLGASTLLKYIAKMVDASVDQIHGYRVDVNKKPEMHTFDVYRKMQSLETFNVNEMPREVLDELAHILTLNTEREGIEEAINTKLKGTFNQDQVLELVQFRKNNSSLFSKGWHNFSLKLMMELIPELYATSEEQMTILTRLGKQKSKEISKRTKYIDEKEITEEIYNPVVAKSVRQAIKIINEATKQYGIFDHIVIEMARLTNEEDAKKDYIKRQKANLDEKNAAMEKAAFQYNGKKELPDSIFHGHKELATKIRLWHQQGEKCLYTGKNIPISDLIQNQYKYEIDHILPLSLSFDDSLSNKVLVLATANQEKGQRTPFQALDRMDDAWSYREFKSYVKDSKLLGNKKKDYLLTEEDISKIEVKQKFIERNLVDTRYSSRVVLNALQDFYKNHHFDTTISVVRGQFTSQLRRKWGLEKSRETYHHHAVDALIIAASSQLRLWKKQNNPLIFYKEGQFVDSETGEILSLNDDEYKELVFKAPYDHFVDTLRSKTFEDSILFSYQVDSKYNRKISDATIYATRKAKLDKDKSKETYVLSKIKDIYSQAGYDAFIKIYNKDKSKFLMYHKDSQTFEKVIEEILRTYPSKEFNDKNKEVPCNPFEKYRQENGPIRKYSKKGNGPEIKSLKYYDKNIPESFINITPSNSKNKVILRQLNPWRTDVYFNHQTEKYELLGLKYADLQFEKKTGTYSITIDKYNEIKEKEGVGEQSEFKFTLYKNDLLLIKDTKNNEKQIFRFLSRTMPNVKHYVELKPYNKAKFDGNQPLITIFGNVAKGGQCLKGLNKPNISIYKIKTDVLGNKYFIKKEGDKPKLKF

SEQ ID NO: 703 - protein, 1129 aa, Artificial Sequence
  Cas9
MADRISLGLDIGVASVGFSVLDIDKGKVIELGSRLFNATVAEGNQDRRSMRGARRLLNRNKQRRQDTGKLFQKFGLLDNFNKDNFYDTFNQNWNPYELRVKGLTEHLTKKELAESLYQIVKHRGISYALKDADADEGGTDYSASLKINSQELAEKTPAQIQLQRLNDYGKVRGQVVIGDDPDNQKVLLNVFPTSAYEKEAKQIIATQKQFYPEILTDEFTKEYCKILTRKRDYFVGPGNEKSRTDYGIYKTDGRTLDNLFEELIGHDKIYPDELRASAASYTAQLFNVLNDLNNLRILSYEDGKLTKEDKEKIIAEIKSNTTTINMLNVIKKVAGCSKEDIKGFRVNEKDKPEISSMAVYRKVHKDLLKVGVDISDWPVEFIDKLSFILTLNTENGEIRKQLNNRLVPEFDFLNDDLIQLIIDNKDSFEIKTNNKWHRFSLKTMNKLMPEMLERPVEQMTLLNEMGLVKKDKKRFENNKYLPYKEIAKDIFNPVASKSVREALKIVNAVLKKYGHIDYLVIEMPRDKNLKEEQDNIKEFQNKNKKAKDAAFEAFVKSVGSEQRVKEALSKNRKLQMKMRLWYQQQEIDPYNGETIDATDLINNPDKFEIDHIIPQSISFDDSINNKTLCFASMNQVKGQKTPYEFMLEGHGQGYDKFKATVLDNKNFDRNKRKNYLFEENVSDIETRKRFLSRNLVDTRYSSRVVLNSLQDFFHEKSADTKVTVIRGKFTSNMRKHWHIDKTRETFHHHAIDASIIAATPFLRMWKKGGTIFPVKVGEESIDIETGEILDDKKFDKVMYEEPYNGFVSEIMNADDRIKFSHQVDKKMNRKVSDATIYSTRTGKLAKDKKDAEYIVAKVKDIYSVDGFKKFKKVYDKDKSKFLLYKYDPRTFSELERIISDCPDKVEKVQTNGKVKAVDVSPFEMYRRYHGMIKKYSKKGNGPAIKQLKYLDKKLGSHIDITPANANGKHVILQSLKPWRTDVYLNHETGEYEIMGIKYSDLKFNKNVGYGIKKDKYLEIKKNEEVSEKSEFMFSLYRKDRVRIQNMKTGESVELLFWSRNFSNKKYAELKPIFKFVTEDDDWPVYGHAKTQILKRLVPKDCKIWKVNTTILGDPYYLEKESDNPKDILD

SEQ ID NO: 704 - protein, 1129 aa, Artificial Sequence
  Cas9
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDDLSREVLDKLADILTLNTEREGIEDAIKRNLPNQFTEEQISEIINVRKSQSTAFNKGWHSFSAKLMNELIPELYATSDEQMTILTRLEKFKVKKKSSKNIKTIDEKEITDEIYNPVVAKSVRQTIKIINAAVKKYGDFDKIVIEMPRDKNADDEKKFIDKRNKENKKEKDDALKRAAYLYNGTDKLPDEVFHENKQLETKIRLWYQQGERCLYSGKPIPIQELVHNSNNFEIDHILPLSLSFDDSLANKVLVYSWTNQEKGQRTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGNNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFVKKYNKDKTQFLMYQKDPLTWENVIEVILRDYPTTKKSEDGKNDVKCNPFEEYRRENGLICKYSKKGKGTPIKSLKYYDKKLGNCIDITPQESKNRVVLRQISPWRADIYFNPETLKYELMGLKYSDLSFEKGTGKYHISQEKYDAIKEKEGVGKDSEFKFTLYRNDLILIKDTLNNCERMLRFGSKNDTSKHYVELKPLEKGTFDSEEEILPVLGKVAKSGQFIKGLNKPNISIYKVRTDVLGNKYFVKKEGDKPKLDFKNNKK

SEQ ID NO: 705 - protein, 1129 aa, Artificial Sequence
  Cas9
MSNGKILGLDIGVASVGVGIIDSKTGNVIHANSRLFSAANAENNAERRGFRGARRLTRRKKHRVKRVRDLFEKYDISTDFRNLNLNPYELRVKGLTEQLTNEELFAALRTIAKRRGISYLDDAEDDSTGSSDYAKSIDENRRLLKTKTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVDFAKKSKALGASKLLKEIAKIVDCSVDDIKGYRVDNKDKPDLHTFEPYRKLKFNLSSIDIDELSRETLDKLADILTLNTEREGIEDAIKRNLPSQFTEEQISEIVQIRKNQSSAFNKGWHSFSAKLMNELIPELYVTSEEQMTILTRLEKFKVNKKSSKNTKTIDEKEITDEIYNPVVAKSVRQTIKIINAAVKKYGDFDKIVIEMPRDKNAEDEKKFIDKKQKENKKEKDDSLKRAAFLYNGTDNLPDGVFHGNKELKTKIRLWYQQGERCLYSGKLISIHDLVHNSNKFEIDHILPLSLSFDDSLANKVLVYAWTNQEKGQKTPYQVIDSMDTAWSFREMKDYVLKQKGLGKKKCEYLLTTENIDKIEVKKKFIERNLVDTRYASRVVLNSLQTALKELGKDTKVSVVRGQFTSQLRRKWNIDKSRETYHHHAVDALIIAASSQLKLWQKQENPMFESYGENQVVNKETGEILSISDDKYKELVFQPPYQGFVNTISSKGFEDEILFSYQVDSKFNRKVSDATIYSTRKAKLGKDKKDETYVLGKIKDIYSQDGFDTFIKRYKKDKTQFLMYQKDPLTWENVIEVILRDYPSEKLSEDGKKTVKCNPFEEYRRENGLICKYSKKGNGTPIKSLKYYDKKLGNCIDITPEKSKNRVVLRQISPWRADIYFNLETLKYELMGLKYSDLSFEKGTGKYHISQEKYDAIREKEGIGKKSEFKFTLYRNDLILIKDTLNNCERMLRFGSKNDTSKHYVELKPLEKGTFDSEEEILPVLGKVAKSGQFIKGLNKPNISIYKVRTDVLGNKFFIKKEGDKPKLDFKNNNK

SEQ ID NO: 706 - protein, 1129 aa, Artificial Sequence
  Cas9
MSNGKILGLDIGVASVGVGIIDAKTGNVIHANSRLFSAANAENNAERRGFRGARRLTRRKKHRVKRVRDLFEKYDISTDFRNLNLNPYELRVKGLTEQLTNEELFAALRTIAKRRGISYLDDAEDDSTGSSDYAKSIDENRRLLKTKTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVDFAKKSKALGASKLLKEIAKIVDCSVDDIKGYRVDNKDKPDLHTFEPYRKLKFNLSSIDIDELSRETLDKLADILTLNTEREGIEDTIKRNLPSQFTEEQISEIVQIRKNQSSAFNKGWHSFSAKLMNELIPELYVTSEEQMTILTRLEKFKVNKKSSKNTKTIDEKEITDEIYNPVVAKSVRQTIKIINAAVKKYGDFDKIVIEMPRDKNAEDEKKFIDKKEKENKKEKDDSLKRAAFLYNGTDNLPDGVFHGNKELKTKIRLWYQQGERCLYSGKLISIHDLVHNSNKFEIDHILPLSLSFDDSLANKVLVYAWTNQEKGQKTPYQVIDSMDAAWSFREMKDYVLKQKGIGKKKREYLLTTENIDKIEVKKKFIERNLVDTRYASRVVLNSLQTALKELGKDTKVSVVRGQFTSQLRRKWKIDKSRETYHHHAVDALIIAASGQLKLWQKHENLMFENYGENQVVNKETGEILSISDDEYKELVFQPPYQGFVNTISSKTFEDEILFSYQVDSKFNRKVSDATIYSTRKAKLGKDKKEETYVLGKIKDIYTQDGFDTFIKRYKKDKTQFLMYQKDPLTWENVIEVILRDYPSEKLSEDGKKTVKCNPFEEYRRENGLICKYSKKGNGTPIKSLKYYDKKLGNCIDITPEKSKNRVVLRQISPWRADIYFNLETLKYELMGLKYSDLSFEKGTGKYHISQEKYDAIREKEGIGKKSEFKFTLYRNDLILIKDTLNNCERMLRFGSKNDTSKHYVELKPLEKGTFDSEEEILPVLGKVAKSGQFIKGLNKPNISIYKVRTDVLGNKFFIKKEGDKPKLDFKNNNK

SEQ ID NO: 707 - protein, 1130 aa, Artificial Sequence
  Cas9
MNKILGLDLGTNSIGWALIENNIILGMGSRVFPEGVVNLGEGEGRETSKNASRTEARGVRRQIFRRRLRKRYLLKELAKHNLCPISPTLIKDWNGTDIFKNELIIQWFQLNPYELRAKAIQEEITLIELGRIFYHMIQRRGFLSNSRSAGADVKETSTIFKGDAKIGKIGISDTLKSIEQNKTLGSFLHSIQPKENEPFSGELERIRNRYTTRQMYIDEFETIWEFQKQYHSELNSNLKTILGGRKKDNYKEDGVLFHQRPLRSQKHLVGFCSFEPKKTKCKLSAIPFELFRIYQWVNTLSYDVNGVRQKITQEERKKIIDLLLSKEKPSFKEIRKAIGKLDGSYQFNYKDDDKIVGSHTISNLSNKKFFGNKWFDFSEKEQENIWHILSFFDDREKLKEYAIKNWSFDEERAVKISKFNLKDGYSNLSRKAILNILPFLQKGFMYDVAVGLAGVKNTLSVNWEEHEQFVLDNVPEIVRSNLKGGYIEPLKNMLKNEFNCNDKQLEKLYHHSSAIETENILDRLPVNLHADREIQKIKNPVVITALFEIRKLVNEVIDTYGKPNEIKVELARDLKASKSNRLEARKRQKDLEKQNDRVKLELENLNQRSNHINILKYKLWEECNHTCPFTGQIITISQLFTGEVQIEHIFPWSRSLNDSFNNKTLCFADENRAKGNKTPYELYSEQGDQKWEAIKLQALSCFKTKANYPNCYNKFKHFVKKKHDEDFISRQLNDTRYISKEAKNYLSKICSNVLVAPGQMTATLRHHWGLNSILNLEDDTKTRDDHRHHAIDALVMACSTRSHLQELSKRNRYNKNYDLKDFPDPWQNFRQDAENAVAQILVSHKKSKSLLTVRTHKTIKKGVEHKNIGVAARGQLHKESVYGLRKAPNSNKAFHIRKPLESLTTEKQLEKIVDDSIRLLILKRINIIGGFIKGKIPKETFFVVDENGIKQPQIFLPNRNGNPVPIKKVRIRENIGGAEKLKENTNQYVNPRSNHHVIVYEDSNGGLKDDVVTFWTAVERKRQGQDVFKLPNDGEKIVSTLQINDMFLLGLNDDDIITLTSKELKKHLFKVQTLSSSFYEFRLSTDSTQNKNTNSTVFRRIQSFGMGKTGWKAFNPIKVKLNSIGEVKII

SEQ ID NO: 708 - protein, 1130 aa, Artificial Sequence
  Cas9
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDDLSREVLDKLADILTLNTEREGIEDAIKRNLPNQFTEEQISEIINVRKSQSTAFNKGWHSFSAKLMNELIPELYATSDEQMTILTRLEKFKVKKKSSKNIKTIDEKEITDEIYNPVVAKSVRQTIKIINAAVKKYGDFDKIVIEMPRDKNADDEKKFIDKRNKENKKEKDDALKRAAYLYNGTDKLPDEVFHGNKQLETKIRLWYQQGERCLYSGKPIPIQELVHNSNNFEIDHILPLSLSFDDSLANKVLVYSWTNQEKGQRTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGNNQVVDKQTGEILSVSDNEYKELVFQPPYQGFVNTISSKGFEDEILFSYQVDSKYNRKVSDATIYSTRKAKIGKDKKEETYVLGKIKDIYSQNGFDTFVKKYNKDKTQFLMYQKDPLTWENVIEVILGDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKEGDKPKLDFKNNKK

SEQ ID NO: 709 - protein, 1130 aa, Artificial Sequence
  Cas9
MTNGKILGLDIGIASVGVGIIEAKTGKVVHANSRLFSAANAENNAERRGFRGSRRLNRRKKHRVKRVRDLFEKYEIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDDLSREVLDKLADILTLNTEREGIEDAIRHNLPNQFTEGQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNGTDKLPDEVFHGNKQLETKIRLWYQQGERCLYSGKPIPIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKISVIRGQFTSQLRRKWKIDKSRETYHHHAVDALIIAASSQLKLWEKQDNPMFVDYGNNQVVDKQTGEILSVSDDEYKELVFQPPYQGFVNMISSKGFEDEILFSYQVDSKYNRKVSDATIYSTRKAKIGKDKKEETYVLGKIKDIYSQNGFDTFIKKYNKDKTQFLMYQKDPLTWENVIEVILRDYPTTKKSEDGKNDVKCNPFEEYRRENGLVCKYSKKGKGTPIKSLKYYDKKLGNCIDITPEGSKNEVVLQSLNPWRADVYFNPETLKYELLGLKYSDLSFEKGTGKYHISQEKYDVIKEKEGIGKKSEFKFTLYRNDLILIKDTASGEQEIYRFLSRTMPNVKHYAELKPYDKEKFDNVQELVEALGEADKVGRCIKGLNKSNLSIYKVRTDVLGNKYFVKKEGDKPKLDFKNNKK

SEQ ID NO: 710 - protein, 1130 aa, Artificial Sequence
  Cas9
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVPTETGKLSTEQKESLVEFAKNTAILGPAKLLKEIAKILDCKVDEIKGYREDDKGKPDLHTFEPYRKLKFNLDSVNIDYLSREVLDKLADILTLNTEREGIEDAIKRNLPNQFTEEQISEIINVRKSQSTAFNKGWHSFSAKLMNELIPELYATSDEQMTILTRLEKFKVKKKSSKNIKTIDEKEITDEIYNPVVAKSVRQTIKIINAAVKKYGDFDKIVIEMPRDKNADDEKKFINKRNKENKKEKDDALKRAAYLYNGTDKLPDEVFHGNKQLETKIRLWYQQGERCLYSGKPIPIQELVHNSNNFEIDHILPLSLSFDDSLANKVLVYSWTNQEKGQKTPYQVIDSMDAAWSFREMKEYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGNNQVVDKQTGEILSVSDNEYKELVFQPPYQGFVNTISSKGFEDEILFSYQVDSKYNRKVSDATIYSTRKAKIGKDKKEETYVLGKIKDIYSQNGFDTFVKKYNKDKTQFLMYQKDPLTWENVIEVILGDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKSLNKPNISIYKVRTDVLGNKYFVKKEGDKPKLDFKNNKK

SEQ ID NO: 711 - protein, 1130 aa, Artificial Sequence
  Cas9
MSNGKILGLDIGVASVGVGIIDAKTGKVIHASSRLFSAANAENNAERRGFRGARRLTRRKKHRIKRVRDLFEKYEIVTDFSNLNLNPYELRVKGLTEQLTNEELFAALRTIAKRRGISYLDDAEDDSTGSSDYAKSIEENRRLLKNMTPGQIQLERLEKYGQLRGNFTVYDENGEAHRLINVFSTSDYKNEARKILETQSNYNKQITDEFIEDYIEILTQKRKYYHGPGNEKSRTDYGRYRTDGTTLENIFGILIGKCTFYPDEYRTSKASYTAQEYNFLNDLNNLKVPTETGKLSTEQKHYLVDFAKSSKALGVAKLLKEIAKIVECSVDDIKGYREDNKGKPDLHTFEPYRKLKFNLSLIDIDELSRETLDKLADILTLNTEREGIEDAIKRNLPNQFTEEQIVELVNVRKNQSSAFNKGWHSFSVKLMNELIPELYASSEEQMTILTRLEKFKVNKKSSENTKTINEKEITDEIYNPVVAKSVSQTVKIINAAVKKYGDFDKIVIEMPRDKNADDEKKFIDKKQKENAKEVEDALKRAAYLYNGTDKLPDGVFHGNKQLKTKIRLWYQQGERCLYSGKPISIQDLVHNSNNFEIDHILPLSLSFDDSLANKVLVYAWTNQEKGQKTPYQVIDSMDAAWSFREMKDYVLNQKGIGKKKREYLLTTENIDKIEVKKKFIERNLVDTRYASRVVLNSIQAALKELDKDTKVSVIRGQFTSQLRRKWKIDKSRETYHHHAVDALIIAASSQLKLWQKQENPMFVDYGENQVVNKETGEILSVSDDDYKELVFQPPYQGFVNTISSKAFEDEILFSYQVDSKYNRKVSDATIYSTRKAKLGKDKKEETYVLGKIKDIYSQDGFDAFIKRYKKDKTQFLMYQKDPVTWENVIEVILRDYPSEKLSEDGKKNVKCNPFEEYRRENGLICKYSKKGKGTPIKSLKYYDKKLGNCIDITPKGSKNEVVLQSLNPWRADLYFNPDTLKYELMGLKYSDLSFEKGTGKYHISQERYDEIKVKEGIGKNSEFKFTLYRNDLILIKDTESGEEELYRFLSRTMPNVKHYVELKPYDKERYDGGQELMKVFGNVANGGQCLKSLNKSNLSIYKVRTDVLGNKFFIKKEGDKPKLDFKNNKK

SEQ ID NO: 712 - protein, 1130 aa, Artificial Sequence
  Cas9
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLKNEELFAALRTISKRRGISYLDDAEDDSTGSTDYAKSIDENRRLLKNKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVSTETGKLSTEQKESLVEFAKNTATLGPAKLLKEIAKILDCKVDEIKGYREDDKGKPDLHTFEPYRKLKFNLESINIDDLSREVIDKLADILTLNTEREGIEDAIKRNLPNQFTEEQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNSSDKLPDEVFHGNKQLETKIRLWYQQGERCLYSGKPISIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGKNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFIKKYNKDKTQFLMYQKDSLTWENVIEVILRDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKKGDKPKLDFKNNKK

SEQ ID NO: 713 - protein, 1130 aa, Artificial Sequence
  Cas9
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDYLSREVLDKLAGILTLNTEREGIEDAIKRNLPNQFTEEQISEIINVRKSQSTAFNKGWHSFSAKLMNELIPELYATSDEQMTILTRLEKFKVKKKSSKNIKTIDEKEITDEIYNPVVAKSVRQTIKIINAAVKKYGDFDKIVIEMPRDKNADDEKKFINKRNKENKKEKDDALKRAAYLYNGTDKLPDEVFHGNKQLETKIRLWYQQGERCLYSGKPIPIQELVHNSNNFEIDHILPLSLSFDDSLANKVLVYSWTNQEKGQKTPYQVIDSMDAAWSFREMKEYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGNNQVVDKQTGEILSVSDNEYKELVFQPPYQGFVNTISSKGFEDEILFSYQVDSKYNRKVSDATIYSTRKAKIGKDKKEETYVLGKIKDIYSQNGFDTFVKKYNKDKTQFLMYQKDPLTWENVIEVILGDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKEGDKPKLDFKNNKK

SEQ ID NO: 714 - protein, 1131 aa, Artificial Sequence
  Cas9
MAQHVFGLDIGIASVGWAILGEQRIIDLGVRCFDKAETAKEGDPLNLTRRQARLLRRRLYRRAWRLTQLSRLLKRKGLIADAKLFAKAPSYGDSAWELRRQGLDRLLTPLEWARVIYHQCKHRGFHWTSKAEEAKADSDAEGGRVKQGLAHTKALMQAKNYRSAAEMVLAEFPDAQRNKRGQYDKALSRVLLGEELALLFATQRRLGNPHASDFFEKLILGDGDRKSGLFWQQKPALSGADLLKMLGKCTFEKGEYRAPKASFSVERHVWLTRLNNLRIVVDGRSRPLNEAERQAALLLPYQTETSKYKTLKNAFIKAGLWGDGVRFGGLAYPSQAQIDAEKTKDPEDQFLVKLPAWHELRKAFKAAGHEALWQQISTPALDGDPTLLDQIATVLSVYKDGAEVVQQLRQLALPEPAASIAVLEKISFDKFSSLSLKALRRIVPLMQSGLRYDEAVAQIPEYGHHSQRIEPGAAKHLYLPPFYEAQRKYAGKGDHIGSMQFRDDADIPRNPVVLRALNQARKVVNALIREYGSPIAVNIEMARDLSRPLDERNKVKRAQEEFRDRNDRARSEFERDFGYKPKAAAFEKWMLYREQLGQCAYSQQPLDIQRVLDDHNYAQVDHALPYSRSYDDSKNNKVLVLTHENQNKGNRTAFEYLTSFPDGEDGERWRTFVAWVQGNKAYRMAKRNRLLRKNYGVDESKGFIDRNLNDTRYICKFFKNYVEEHLQLAARADGDTARRCVVVNGQLTAFLRARWGLTKVRGDSDRHHALDAAVVAACTHGMVKALADYSRRKEISFLQEGFPDPETGEILNPAAFDRARQHFPEPWTHFAHELKARLFTDDLAALREDMQRLGSYTTEDLGRLRTLFVSRAPQRRSGGAVHKETIYAQPESLKQQGGVIEKILLTSLKLQDFDKLLNPESNDHFVEPHRNERLYAAIRQRLEQFGGRADKAFGPDNLFHKPDKNNQPTGPVVRSIKLVRGKQTGIPIRGGLAKNDSMLRVDIFTKAGKFHLVPVYVHHRVTGLPNRAIVAFKDEDEWTLIDESFAFLFSVYPNDYVKVTLKKEQQSGYYSGADRSTGAMNLWAHDRAASVGKDGLIRGIGVKTALSVEKFNVDVLGRIYLAPPETRSGLA

SEQ ID NO: 715 - protein, 1132 aa, Artificial Sequence
  Cas9
MAQYVFGLDIGIASVGWAVLDAQRIVDLGVRCFDKAETAKEGDPLNLTRRQARLLRRRLYRRAWRLTQLARLFKREGLIDDAKLFAKAPSWTENAWELRLRGLDHLLTPLEWARVIYHLCKHRGFHWTSKAEEAKAESDAEGGRVKQGLAHTKALMQVKNYRSTAEMVLAEFPGAQRNKRGQYDKALSRVLLGEELALLFATQRRLGNPHASEHFEQLILGHGDRKSGLFWQQKPALSGADLLKMLGKCTFEKTEYRAPKASFSAERHVWLTRLNNLRIVVDGRARPLNDAERQAALLLPYQTETFKYKTLKAAFVKVGLWGDGVRFGGLAYPSQAQAEAEKAKDPEDQFLVKLPAWHELRKAFKAAGHEALWQQISMPALEEDPTLLDQIATVLSVYKDGTEVVQQLRQLALPEPDASIAVLEKIRFDKFSSLSLKALRRIVPLMQGGLRYDEAVAQIPEYGHHSQRIDPGATRHLYLPPFYEAQRKYAGKGDRIGSMQFREDADVPRNPVVLRALNQARKVVNALIREYGSPVAVNIEMARDLSRPLDERNKVKRAQEEFRDRNDKARSEFERDFGYKPKGAVFEKWMLYREQLGQCAYSQQPLDIQRVLDDPNYAQVDHALPYSRSYDDSKNNKVLVLTRENQNKGNRTPFEYLTSFPGGEDGERWRAFVAWVQGNKAYRMAKRNRLLRKNYGTDESRGFIDRNLNDTRYICKFFKNYVEEHLQLAARTDGDTARRCVVVNGQLTAFLRARWGLAKVRGDSDRHHALDAAVVAACTHGMVKALADYSRRKEIAFLQEGFPDPETGEILNLAAFDRAREHFPEPWPHFAHELKARLFIDDLVALREDMQHLGSYAQDDLDRLRTLFVSRAPQRRNGGAVHKGTIYAQPENLKQQGSTIEKILLTGLKLQDFDKLLNPESSDHFVEPHRNERLYAAIRRRLEEFGGKADKAFGPDKPFYKPDKNGQPTGPIVRSIKLVRGKQTGIPIRGGLAKNDSMLRVDVFTKAGKFHLVPVYVHHRVTGLPDRAIVAFKDEEEWTLIDESYAFLFSVYPNDFVCVQQRGKPLIEGYYAGLDRANGNINVWAHDRAASVGKDGLIRGIGVKTALSLEKLNVDVLGRIYPAPPETRRGLA

SEQ ID NO: 716 - protein, 1132 aa, Artificial Sequence
  Cas9
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 717 - protein, 1133 aa, Artificial Sequence
  Cas9
MDLNYRIGLDIGIASVGWAVLENNSKDEPVRIVDLGVRLFEAAEVPKTGAALAEPRREARTTRRRLRRRKHRLERMKWLLQEYGLIQTEEFMKRYHSAGLPDVYRLRYEGLERKLKDEELAQILIHIGKHRGFRSTRKAELKDKNDKETGAVLSATRENEKLMEEHGYRTAGEMIYKDDKFRTGCTWKEEGYRLTPRNKEGDYKNTMLRALLEDEVKVIFDCQRKFGNQKASEELEKAYLAIMTSQRSFDMGPGKQPDGSASPYAMEGFGDRVGLCALEPREKQEPRAPKAAYTSELFVALQKINHLRITEKNGKGRGLTSEERERLSDLLHKKKELTYGAVRKELQLDLRYRFNTLNYSSKKMTEEEKIKDAEKAKFVSMVSHYEYRKRMSGMLEQLSPEEQADLMDEVGKILTLYKNDDTRSREFQKLGLDSEITEELLELNPRGFQHVSLKAMKKLMPYLKEGLTYDKACAEAGYDFQGSVQKERSRLLKGKEITDIINDINNPVVKRSVSQTVKVINAIIQKYGSPQAVNIELAREMSRNYDERRKMEKQMKDRQSENERAKKEIQELGNAFPTGQDILKYRLWHDQDGICMYSAKRIPLAELFTGAYDIDHILPYSITFDDSYRNKVLVTSEENRQKGNRIPYEYFGSDSERWSKFETLVNSRIRDYRKQQNLLKQSFTEEERKEFKQRNLNDTKYITRVIYNMIRENLALAPYNSPGKKKQVFAVNGGVTAYLRKRWGMSAKDRSIDTHHARDAVVIACCTDGMIQKISRNIQGRELLYARGFTAVDVETGEKFTRDDFTRDQWDEIFGVQVPKPWEYFNEELDIRLGENPVEFIETHSDVSRKLDYPAWFYENNIIRPVFVSRMPNRKVTGAAHADTIRSPRHYQETGSVLTKTALIDLKLNKKTGEIENYYKPESDTLLYNALKERLELYGGDGKKAFEEPFYKPKADGSRGNLVRKVKTYDKLTLGVYVNSQHGIAANANGSMVRVDVFRVSGKYYFVPVYIADVVRKRLPMKAVVQGKQYIDWKEMEDKDFIFSLYTRDLISFKSKNGKKVTCVDGTSKAVNEEIVYYYGANISTASFSGKSHNGSFEFTSLGIQGLEYLKKYQVDVLGNVSEVKREKRMGFR

SEQ ID NO: 718 - protein, 1133 aa, Artificial Sequence
  Cas9
MGGFEVDRKISLGLDIGVSSVGYSVIDVDTGKVLELGSRLINGKIGTENQARREMRGTRRLINRKKQRRKDTVKLFNEFKLIDSKKDEHYFDHFANNSDPYELRVKGLSEKLSLSEIADGLYHIVKRRGISYDLKDADEESEGSEYENGLKINNSELKNQTPAQIQLKRLNEYGAIRGKVVIDEEKILLNVFPTKAYLDEAKRIIEKQREFYPGILTEEFEEKYCQILTRKRDYFVGPGSEKSRTDYGIYKEDGRTLNNLFEELIGHDKIYPEELRASGASFTAQLFNVLNDLNNLHISSYEDQKLTTENKEQIISELKSTTSNVNMMKLIQKIAGCEESDISGYRTDKNYKPEISSMRIYRKVHKKLLESEIDITNWPDDFINKLSFILTLNTENGEIRNQLKNRLQPEYDFLTDELIQTIIDNKESFDIKSNNKWHRFSIKTMELLIPEMIKRPVEQMTLINEMGLIKNSGKKFSNYKYLPYKKIAEDIYNPVASKSVREALKIVNAILKEYGHIEYIVVEMPRDKNEDEAKDQIEKFQKANGRLKDAALEEFTEAIGDKSTVDKKLGVHRSKLLFKIRLWYQQRGMDLYEGKPISAVDLLNNPDSFQIDHIIPQSVSFDDSFNNKTLCNSGLNQIKDKKTPFEYMNEGYGQGFDSMKAMVMKNPRIDHNKRKNYLFSENVSDIETRKRFISRNLVDTRYASRVVLNNLQEFFKEKESDTKISIIRGKFTSNLRKHWKINKNRDTYHHHAIDATIIAATPFLNIWKKGSSIFPSNVESEDFFDIKTGKIIGNDEFNKYAYDEPYNGFYNELRNATDRIKFSHQIDKKMNRKVSDSTIYSTRVAKSPKNKKESEYIVAKIKNIYDADEYAKFKRIYDKDKTKFLLNKYDPRSFNHLEKIMNTYPDSIERTMSNNKVKVVRISPFELYRQDHGPVKKYSKKNNGPEIKQLKYLDKKVGSSIDVTPDNAKNKHVILKSLKPWRTDIYLNHETGEYEIMGIKYSDLKFNKGEGYGIKKAKYLEIKHREKVSDDSEFMFTLYKKNRIKVENMETDESVEMLFWSRTMDSQKGYAELKPIYKYKTEDDNWPIYGNAKKQIIKKLIPKNCKIWKVNTDVLGNPFYVEKEGEYPKDVLD

SEQ ID NO: 719 - protein, 1134 aa, Artificial Sequence
  Cas9
MNGLVLGLDIGIASVGVGILEKNSGKIVHASSRIFPAATADNNVERRKNRQARRLHRRKKHRGARLKDLFEYYGLLTDFSKVSINLNPYRLRVDGLDQQLTNEELFIALKNIVKRRGISYLDDASEDGGTVSSDYGKAVEENRKLLAEQTPGQIQLERFEKYGQLRGDFTVVENSEKCRLINVFSTSAYKKEAERILRKQQEFNNQITDEFIEDYLKILTGKRKYYHGPGNEKSRTDYGRFRTDGATLDNIFGILIGKCTFYPNEYRASKASYTAQEFNLLNDLNNLTVPTETKKLSEEQKKTIIEYAKSAKTLGASTLLKYIAKMIDASVDQIRGYRVDVNNKPEMHTFEVYRKMQSLETISVGELSRNILDELAHILTLNTEREGIEEAINTKLRDSFSQDQVLELVQFRKNNSSLFSKGWHNFSLKLMMELIPELYETSEEQMTILTRLGKQKSKETSKRTKYIDEKEVTEEIYNPVVAKSVRQAIKIINEATKKHGIFDNIVIEMARENNEEDAKKDYIKRQKANQDEKYAAMEKAAFQYNGKKELPDNIFHGHKELATKIRLWHQQGEKCLYTGKSIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLVDTRYSSRVVLNALQDFYKNHNFDTTISVVRGQFTSQLRRKWGLEKSRETYHHHAVDALIIAASSQLRLWKKQNNPLIAYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKAGKLVDFNPFEKYRQENGPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQFFRFWSRTGKDNPKSFEKHKIELKPYEKAKFEKGEELEVLGKVPPSSNQFQKNMQIENLSIYKVKTDVLGNKHFIKKEGDKPKLKF

SEQ ID NO: 720 - protein, 1134 aa, Artificial Sequence
  Cas9
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKLRLINVFSTSAYKKEAERILRKQQEFNNQITDEFIEDYLKILTGKRKYYHGPGNEKSRTDYGRFRTDGTTLDNIFGILIGKCTFYPEEYRASKASYTAQEFNLLNDLNNLTVPTETKKLSEEQKKVIVEYAKEAKTLGASTLLKYIAKMIDASVDQIRGYRVDVNNKPEMHTFEVYRKMQSLETISVGELSRNVLDELAHILTLNTEREGMEEAINTKLKDSFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPDNIFHGHKELATKIRLWHQQGEKCLYTGKTIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLIDTRYSSRVVLNALQDFYKAHKFDTTISVVRGQFTSQLRRKWGLEKSRETYHHHAVDALIIAASSQLRLWKKQNNSLISYKEGQFVDSETGEIISLTDDEYKELVFKAPYDHFVDTLRSKKFEDSILFSYQVDSKFNRKISDATIYATRKAKLDKEKKEYTYTLGKIKDIYSLGTKAPSKTGFYKFLDLYNKDKSQFLMFQKDRKTWDEVIEKIMEQYRPFKEYDKTGKLVDFNPFEKYRQENGPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQIFRFWSRTGKDNPKSFEKHKIELKPYEKARFEKGEELKVLGKVPPSSNQLQKNMQIENLSIYKVKTDVLGNKHFIKKEGDEPKLKF

SEQ ID NO: 721 - protein, 1134 aa, Artificial Sequence
  Cas9
MNGLVLGLDIGIASVGVGILEKNSGKIIHENSRLFPAATADNNVERRKNRQARRLNRRKKHRGVRFQDLFEDYGLLTDFSKVSINLNPYRLRVDGLNQQLTNEELFIALKNIVKRRGISYLDDASEDGGTVPSDYGKAVKENRKLLAEKTPGQIQLERFEKYGQLRGDFTVEENGEKCRLINVFSTSAYKKEAERILRKQQEFNNQITNEFIEDYLKILTGKRKYYHGPGNEKSRTDYGRFRTDGTTLDNIFGILIGKCTFYPEEYRVSKASYTAQEFNILNDLNNLTVPTETKKLSEEQKKDIVEYAKETKTLGASTLLKYIAKMIDASVDQIRGYRVDVNNKPEMHTFEVYRKMQSLETISVGELSRNVLDELAHILTLNTEREGIEEAINTKLMGVFSQDQVLELVQFRKNNSSLFSKGWHNFSLKLMMELIPELYETSEEQMTILTRLGKQKSKETSKRTKYIDEKEVTEEIYNPVVAKSVRQAIKIINEATKKYGIFDNIVIEMARENNEEDAKKDYIKRQKANQDEKNAAMEKAAFQYNGKKELPDSIFHGHKELATKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTRYSSRVVLNALQDFYKAHKFDTTISVVRGQFTSQLRRKWGLEKSRETYHHHAVDALIIAASSQLRLWKKQNNPLITYKEGQFVDSETGEIISLTDDEYKELVFKAPYDHFVDTLRSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKTGKLVDFNPFEKYRQENGPICKYSKKGNGPEIKSLKYYDILLGKHKNITPEGSRNTVALLSLNPWRTDVYYNMETKKYEFLGLKYADLPFEKGGAYGISTETYNKLREKEGIGKNSEFKFTLYKNDLILIKDTETNCQQIFRFWSRTGKDNPKSFEKHKIELKPYEKARFEKGEELEVLGKVPPSSNQFQKNMQIENLSIYKVKTDVLGKKHIIKKEGDEPKLKF

SEQ ID NO: 722 - protein, 1134 aa, Artificial Sequence
  Cas9
MKYIESVSIGFDIGVGSVGYAVINSKTKQILESGVSIFPAAVAQKNVERRESRQSRRLRRRRVNRLNDLKKLLKKNGFIPSPNKNPYEIRVRGLEHQLSRDEIAIAVLHIAKRRGISYSLDDVVDENVTDFKGKIAKNQEALKNKTPGEIQYERLLKYGKVRGTVTNYVEYDEQPEYFLNVFPNSAYVDEAKRILTCQKQYYPEITDDLIENIVKIISRKRAYYIGPGNEKSRTDYGIYRTNGETLENIFEILIGKDSVNPDELRAPANSLTAQVYNLLNDLTNIRYNGSERLTPEQKQDILSELLTTEKTVQMLNVIAKKVNVKKEEISGFRTKKDDKPDFHTLEVYRKVRKHMLNKGIDINEWPTECFDELAFIFNLNTEIGEIRNRISEKVVPKYDFITNQIVDDLLEDPKIFAISTSQKWHRFSIKTMNVLIPELLNGYNEQMTILTRMGLLEDSKNDYSNIDKIDIKNVTENIYNPVVRKSIKKCLKIFNELYKKYPNISDVVIELPREDNPEDARKLIKKMQKENLVEKDTSLEAFRKEANLSENGLIDFLRKGKNRALKIRLWYQQEGKCLYTGEPILAEDLCKNEANYDIDHIIPISVSFDDSINNKVLCSSHFNRFEKEKKTPFEYFSNKSSHLGRYSNFDEFRASVNANKRISDVKRKNLLSKELLSDLDTRKKFIARNLVDTRYASRVVFNELTQFFASKKADTKVAVIRGKFTSQLRRAWQLNKSRDTYHHHAVDAALIGVTPFLKIWRSGKTIYPRKMTEAQTDFELNEITTNDEFKESYYQLPCPQFLDYLTQMQENLKINFEVDKKMNRKISDAMIYSSRKKKLSKDKKEKEYSLGTINDIYSDAGYSKFKNIYKKDKEKFLMYHLDHKSFEILEDIISQYPDKEEYIDSEGKVKQRAVSPFEIYRRKYGYIRKYSKKNNGPIIKNMKYYNENLPKIYIDITPKQSIDKKVYLTNISPWRTDVYYNRSQNSYHIMGIKYSDLRYIDGKYGIPKNVYEKIKLREKIPSESEFCFSLYKNDRVKIIDPNKNEEIELRFNSRTLPSVLNYVEFKPLFQESYNSLTLLPVFSKTTSEGRIIKKFTREDNIVYKVNTDELGNPYYILKESQNPKNIIDNSNKTE

SEQ ID NO: 723 - protein, 1134 aa, Artificial Sequence
  Cas9
MNGLVLGLDIGIASEGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKLRLINVFSTSAYKKEAERILRKQQEFNNQITDEFIEDYLKILTGKRKYYHGPGNEKSRTDYGRFRTDGTTLDNIFGILIGKCTFYPEEYRASKASYTAQEFNLLNDLNNLTVPTETKKLSEEQKKVIVEYAKEAKTLGASTLLKYIAKMIDASVDQIRGYRVDVNNKPEMHTFEVYRKMQSLETISVGELSRNVLDELAHILTLNTEREGMEEAINTKLKDSFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPDNIFHGHKELATKIRLWHQQGEKCLYTGKTIPISDLIYNQYKYEIDHILPLSLSFDDSLSNKVLALATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKTGKLVDFNPFEKYRQENEPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGDKPKLKF

SEQ ID NO: 724 - protein, 1135 aa, Artificial Sequence
  Cas9
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLACDIADIKGYRIDKSDKAEIHTFEAYRKMKTLETIDIEQIEREKLDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFKAHKIDTKVSVVRGQFTSQLRRHWGIDKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYALGTKTPSKTGFYKFLDLYNKDKSQFLVYQKDRKTWDEVIEKIMEQYRPFKESDKNGKEVDFNPFEKYRIENGPIRKYSRKGNGPEIKSLKYYASKLGNHIDITPKDSNNKVVLQSVSPWRADVYFNKTTGSYEILGLKYADLQFEKGTGTYRISEEKYNDIKKKEGVDSDSEFKFTLYKNDLLLIKDTETKEQRLFRFLSRSMPNKKHYVELKPYSKDKFEKNESLIEILGSADKSGRCIKGLAKSNLSIFKVRTDVLGNQHIIKNEGDKPKLDF

SEQ ID NO: 725 - protein, 1135 aa, Artificial Sequence
  Cas9
MGVIFLYENIVKPFPSRYDKAIMKRLKGRQTMGYILSLDIGIASCGYSVLETDALGVPYKIKTLNSIIFTRAENPKTGASLAEPRRKYRGARRRKRRTSFRKHRTRQLFITSGLLSKQDIARYLNQQEPHDDIWELRVKGLDEPLTNLQLFQVLYYFVTHRGFKSNRKAELKDKDIGPVLNSINAFKEEMQSHDYRTIGELYANDPRFRDRKHNKDYTNGFLGTIQRSWLVDEIKMLLTNQQSFGNTQLTSEFIELYLNIFTSQRNFDDGPASGPYSGDLIDKMVGPDTFNRSRKRAPRATYTFQYFSFLSKLNSLRIAPSISAPFETLTVDQRALITKRLWGPDVKSADLKFKQIRMVLSLPETARFNLVNYGNTPEKALEIEDKTTFISIKPLREIEKALTGTTLPVSHDQLDAIARILTVYKSDSNRKTAFHNQTVLSDEVIEQLLPLNFSKFGHLSVETMQEIIPYLEQGMVYSDAATAAGYDFRNNQIDMEYIRDNVTNPVVRRAVSVANKLVKAVVRRYGKPDSIHIELARDLSQNFQERRQDEVRQQKNARDNEKIAKRLEELGIPVNGVNITKMKLYDEQHGIDLYDLSTNASMAVTDIFSDDRYEIDHIIPYSVSFDDSYTNKVLVSAKANREKRDRIPMEVFGNDSERRRQFENRVNTNITNLRKKRNLLKETFSDEDKAKWKSRNINDTRYLNRILMNYLSQNVEFTDVLSDAKHVIALNGAVTAKIRSRWGITKVRAAGDLHHAVDAVVIGCVTDALIQAVTRYAKYQERRDNKAAAEQDLAENNPEELDAKQFRKVFNDYPLPWPEFREELMGRVSSDPSQIMAGRQWSHYTAEEISELKQPFVVRVPNHRIVGPATLDTVYGQPNPDDGLITQRVRITDLKPQKNKDGEDIIKAGANVYELAADGGNKLVYESILDALQVAGGDGKKAFPTGRLLVRSPIQDIPVERVRVTSKATLVVPVGPKSVAANGSMVRIDVYKTPKKYVFVPIYVRDTVKAELPDRAVAPVKPYSQWYQLQPKDQFLFSLFANDLIRFKHPRGVSTKEILTDGSQEKGKRTDVVGYFTGADIATASIAIEGPDRSFSARGIGFASLKNVEKLTVNYFGELHSVHETQPMQFRGQRG

SEQ ID NO: 726 - protein, 1136 aa, Artificial Sequence
  Cas9
MNGLVLGLDIGIASVGVGILEKDTGKIIHASSRLFPAATADNNVERRSNRQGRRLNRRKKHRSVRLQDLFESYGLLTDFSKLSINLNPYQLRVQGMENQLTNEELFIALKNIVKRRGISYLDDASEDGGTVSSDYGKAVEENRRLLTEKTPGQIQLERFEKYGQLRGDFTVEENGEKRRLINVFSTSAYRKEAERILRKQQEFNNKITDEFIEDYLTILTGKRKYYHGPGNEKSRTDYGRFRTDGTTLDNIFGILIGKCTFYPEEYRASKASYTAQEFNLLNDLNNLTVPTETKKLSEEQKKTIIEYAKSAKTLGASTLLKYIAKMIDASVDQIRGYRVDVNNKPEMHTFEVYRKMQSLETIKVEELPRKVLDELAHILTLNTEREGIEEAINSKLKDTFNRDQVLELVQFRKNNSSLFSKGWHNFSLKLMMELIPELYETSEEQMTILTRLGKQRSKETSKRTKYIDEKELTEEIYNPVVAKSVRQAIKIINEATKKYGIFDNIVIEMARENNEEDAKKNYIKQQKANQDEKNAAMEKAAFQYNGKKELPDNIFHGHMELATKIRLWHQQGEKCLYTGKNIQISDLIHNQYKYEIDHILPLSLSFDDSLSNKVLVLATANQEKGQRTPFQALDSMDDAWSYREFKSYVKESKLLGNKKKDYLLTEEDISKIEVKQKFIEKNLVDTRYSSRVVLNALQDFYKKHQFDTTISVVRGQFTSQLRRKWKLEKSRDTYHHHAVDALIIAASSQLRLWKKHNNPLISYKDGQFVDSETGEIVSLSNEEYKELVFKAPYDHFVDTLRSKKFEDSILFSYQVDSKYNRKISDATIYATRKAKLDKDKKEYTYTLGKIKDIYALGTKTPSKTGFYKFLDLYKTDKSQFLMYQKDRKTWDEVIEKIIEQYRPFKEYDKNGKEVDFNPFEKYRIENGPIRKYSRKGNGSVIKSMKYYDNLLGKFVDITPSESKNPVALLSLNPWRTDVYYNPETRKYEFLGLKYADLCFGKGGSYGISEVKYNKIREKEGIGKESEFKFTLYKNDLILIKDTETNCQQFFRFWSRTGKDNPKSFEKHKIELKPYEKAKFEKGEELEVLGKVPPSSNQFQKNMQIENLSIYKVKTDVLGNKHFIKKEGDEPKLKFKK

SEQ ID NO: 727 - protein, 1136 aa, Artificial Sequence
  Cas9
MNGLVLGLDIGIASVGVGILKKDTGEIIHTNSRLFSAATADSNIERRRHRGGKRLTRRKKHRSIRLHDLFEDSGLLTDFSKVSINLNPYQLRVQGLDNQLTNEELFIALKNIVKRRGISYLDDASEDGGTVSSDYGKAVEENRKLLAEQTPGQIQLDRFEKYGQVRGDFTVVENGEKRRLINVFTTSAYSKEAERILRKQQEFNKKITDEFIENYLTILTGKRKYYHGPGNEKSRTDYGRYTTKKDPEGKYITLDNIFGILIGKCTFYPDEYRASKASYTAQEFNLLNDLNNLTVPTETKKLSEEQKKTIIKYAKTAKTLGASTLLKYIAKLIGASVDQIHGYRIDPNKKPEMHTFETYRKMQSLETISVEEIPRKVLDELAHILTLNTEREGIEEAINATLKDTFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKYGIFDNIVIEMARENNEEDAKKGYNERQKANLDEKKSAMEKAAFQYNGKKELPDNVFHGHKELATKIRLWHQQGEKCLYTGKNIPISDLIQNQYKYEIDHILPLSLSFDDSLSNKVLVLATANQEKGQRTPFQALDSMDDAWSYREFKSYVKDLKLLSNKKKDYLLTEEDISKIEVKQKFIERNLVDTRYSSRVVLNALQDFYKEHQFDTTISVVRGQFTSQLRRKWGLEKSRETYHHHAVDALIIAASSQLRLWKKQNNPLISYKEGQFVDQETGEIISLSDDEYKELVFKAPYDHFVDTLKSKKFEDSILFSYQVDSKYNRKISDATIYATRKAKLDKEKKEYTYTLGKIKDIYALGSEKLKTGFYKFLHLYKKDKSQFLMYQKDRKTWDEVIEKILEQYRPFKEKDKNGKEVDFNPFEKYRIENGPIHKYSRKGNGPVIKSLKYYDKNIPESFINITPSNSKNKVILRQLNPWRTDVYFNHQTEKYELLGLKYAHLQFEKKTGNYSITIDKYNEIKEKEGVSEQSEFKFTLHKNDLLLIKDTETKEQQLFRFLSRTKPNVKHYVELKPYSRDEFEKNERLIEILGSVDKSGRFVKGLGKSNLSIYKVRTDVLGNQHIIKKEGEEPKLKF

SEQ ID NO: 728 - protein, 1136 aa, Artificial Sequence
  Cas9
MNGLVLGLDIGIASVGVGILEKDTGKIIHASSRLFPAATADNNVERRSNRQGRRLNRRKKHRSVRLQDLFEGYGLLTDFSKVSMNLNPYQLRVQGMENQLTNEELFVALKNIVKRRGISYLDDASEDGGTVSSDYGKAVEENRKLLAEKTPGQIQLERFEKYGQLRGDFTVEENGEKHRLINVFSTSAYRKEAERILRKQQEFNSKITDEFIEDYLIILTGKRKYYHGPGNEKSRTDYGRFRTDGTTLDNIFGILIGKCTFYTEEYRASKASYTAQEFNLLNDLNNLTVPTETKKLSEEQKKLIIEYAKSAKTLGASTLLKYIAKMIDASVDQIRGYRVDVNNKPEMHTFEVYRKMQSLETIKVEELPRKVLDELAHILTLNTEREGIEEAINSKLKDIFNRDQVLELVQFRKNNSSLFSKGWHNFSIKLMMELIPELYETSEEQMTILTRLGKQRSKETSKRTKYIDEKELTEEIYNPVVAKSVRQAIKIINEATKKYGIFDNIVIEMARENNEEDAKKDYIKRQKANQDEKNAAMEKAAFQYNGKKELPDNIFHGHKELTTKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTRYSSRVVLNALQDFYKSHQLDTTISVVRGQFTSQLRRKWGIEKSRETYHHHAVDALIIAASSQLRLWKKHSNPLIAYKEGQFVDSETGEIVSLSDEEYKELVFKAPYDHFVDTLRSKKFEDSILFSYQVDSKYNRKISDATIYATRKAKLDKEKKEYTYTLGKIKDIYALGTKTPSKTGFYKFLDLYKTDKSQFLMYQKDRKTWDEVIEKIIEQYRPFKEYDKNGKEVDFNPFEKYRIGNGPIRKYSKKGNGPEIKSLKYYDILLGKHKNITPDGSRNTVALLSLNPWRTDVYYNSETKKYEFLGLKYADLCFEEGGAYGISEVKYKKIREKEGIGKNSEFKFTLYKNDLILIKDTETNCQQFFRFWSRTGKDNPKSFEKHKIELKPYEKAKFEKGEELKVLGKVPPSSNQFQKNMQIENLSIYKVKTDILGNKHFIKKEGDEPKLKFKK

SEQ ID NO: 729 - protein, 1139 aa, Artificial Sequence
  Cas9
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLSCDVADIKGYRIDKSDKAEIHTFEAYRKMKTLETLDVKKMAREELDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFRTHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRKAKLDKEKKEYTYTLGKIKDIYALGTKTPSKTGFYKFLDLYKKDKSQFLMYQKDRRTWDEVIEKILEQYRPFKEKDKNGKEVDFNPFEKYRIENGPIRKYSRKGNGPEIKSLKYYDNLLGRFVDITPSESKNPVALLSLNPWRTDVYYNTETRKYEFLGLKYADLCFEKGGSYGISKVKYNKIREKEGIGKNSEFKFTLYKNDLILIKDTETNRQQIFRFWSRTGKDNPKSFEKHKLELKPYEKTRFEKGEELKVLGKVPPSSNRLQKNMQIENLSIYKVRTDVLGNQHIIKNEGDKPKLDF

SEQ ID NO: 730 - protein, 1139 aa, Artificial Sequence
  Cas9
MNYYNGFIITENAMASKHENLGALTFGLDIGIASVGWAVLGENRIIDLGVRCFDKAETAKEGESLNLARRTARLLRRRLRRRAWRLTKLARLLKREGLIADTNVFQKPFNLKDANEKGLSFWQLRVDALDRKLSAEEWARVIYHLCKHRGFHWISRAEEKAAEGDSKSEGGKVKQGLAGTKKLMQEKNYRTAAEMVLTEFPEAQRNKQGDYSKALSRILLGDEMTQLFKHQRELGNPHATEKLEAAILGNGDHKSGLFWAQNPALAGNDLLKMLGHCTFEKAEYRVPKASFTAERHVWLTRLNNLRIVVDGTTRPLNEAERHLALLMPYQQAGDLTYKQLRTALTKAGYLPESFRYTGLAYASGQKADEKAKDPESAPLVKLPAWHELRKTLEKKELASEWQKISSDALDGKPQLLDQIAWVLSVYKDDTEVEAELCKLNLPNAEKMIDALLDIRFDKFSNLSLKALRQIVPLMEQGQRYDEAVANIPEYGHHSQLHEVGAGEHKYLPPFYKERDKTGRMVFNDDMDIPRNPVVLRALNQARKVVNALIKEYGSPHEVHIEMARDLSRPLDERRDVEKLQKEFRDRNEKDKALFAQDFNIVGAVKGKEFEKYQLYREQQGKCAYSIEPMDIHRLFEQGYVEIDHALPYSRSFDDSKNNRVLVLAKENRDKGNRTPFEYLGGKDNSERWRQFVAFVEGNKSYRLAKRSRLLRKDFGKDEAKGFRERNLNDTRYICRFFKNYVEQYLQLHEDSDAKRCVVLSGQMTSFLRARWGLVKVRGDSDRHHALDGAIVAACSHSMVKRLSDYSRRKELEQVRAGFVDVDTGEIVNPAMFQQVQEHFPNPWPHFRDEVKLRLNVDDPALLHSEMNRFGTYSPEALKALRPLFISRAPQRRNSGAAHKDTIYAQPERLVAQGGVTQKVPLTSLTLKDLDKLIDPHRNEKLYSAIRIRLEQHGGKGDKAFPASNPLRKPDSEGNPTGPIVRGVTMVIDKLSGIPIRGGIAKNDSMVRVDVFTKAGKFHLVPVYVHHAVAKVLPNRAVVAYKDETEWTLIDDGFDFCFSMYPNDLLRIKLRNASHLGYYASCNRSTGAINLWSHDRNQQVGKDGMIESIGVKTALNVEKLNIDVLGNRYPAPPEKRRDLA

SEQ ID NO: 731 - protein, 1140 aa, Artificial Sequence
  Cas9
MKNMTKVNVGLDVGISSAGWSVINAETNQILESGVRLFSGSDADENVNRRNQRQGRRLFRRRKLRIQEAKKYLENVFQLKDIEPKDEWNPYEIRVRALNEKVSKEELSIALLNIVKHRGISYELEDVTDEEGTNTQSFQSGLDYNRRLLKTKTVGEIQYDRLQKYGQVRGQIQTEDGLLINIFPTKNYVEEVERILETQKKYHPEIDDVFIEKIISFVTRKREYFVGPGNEKSRTDYGIYRENGETLDNLFEILIGKDKFYPEEYRAAGSSYTAQIFNLLNDLNNLRIPTTEDHHLTKAQKEEIITELKNTSRLSGGMLKLISKVTKAPKEEISGYRKDEKDKPDLHSLAYYRKQKNMLEKEGIQIADFSEELLDELATMMTLNTEPGEIRKQLNKITNQYDILTPEVIEVLVKNHTAFVATSNHKWHRFSLKLMKEFIPELLETSKEQSTILCERGFIQNRASYLDENHHFNYAELRENLYNPVVRKSTCEMLKVFTAIQEKYPNIQNVIVELPRETNEDEQKRKIKKINDNNAKRKKEILKEAQAQSGLSEEALEEKLLKTKGLYLKLMLWYEQEGKCVYSGQEIPLSDLLQNKGGYEVDHIIPISISFDDRLCNKVLVRQQLNSQKSNQTPFEYMTTHTDGHLSFHELKELVGKNKRFSKEKRELLLAEIYSNDIETRKRFINRNLVDTSYTARIVLNALQQYKKENQLSMNVSVVRGAMTNILRKKVKLDKTRETFHHHAIDASLMAVIPNIEFFKERKEWLPKSANEEVVEVEVSEEETMPEKEFKVKMRLPESFIQDVQILQRNSFAKEEVSGPQTRERNLKIKFSHQVDQKMNRKVADDTIYGTRQAQLGKDKKEETYVIGKIKDIYNYDEYVRFKKRYDKNKESFLMYHHDPQTFEKLEEILAQYPEYIEDEKGKKKKVSPFALYREENGPVTKYAKKNNGPVIKQLKYYDSKLNRKIDISHKYSTKNRQVVLQSLKPYRTDVYRNQDTGEYTLVGIDQNDGKFVNGHYGIPKSRYEEIKANNKLSEHDEFVFSLYKNSMVKVIDENGESIVVRYLSRSMPNRKNNAEIKPVEKYQFEDGEVVPVYGKCRKQMQTVFVKKGWTLLKGNTDILGNTYFVEKESENPKKMIDDK

SEQ ID NO: 732 - protein, 1140 aa, Artificial Sequence
  Cas9
MRENGSDERRRNMDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRTGCSWSEKGYILTPRNKAENYQHTMLRAMLVEEVKEIFSSQRRLGNEKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTAHKPYGEWKVMEDKDFLFSLYSRDLIHIKSKKDIPIKMVNGGMEGIKETYAYYIGADISAANIQGIAHDSRYKFRGLGIQSLDVLEKCQIDVLGHVSVVRSEKRMGFS

SEQ ID NO: 733 - protein, 1140 aa, Artificial Sequence
  Cas9
MNGLVLGLDIGIASVGVGILEKNSGKIVHASSRIFPAATADNNVERRKNRQARRLNRRKKHRGVRFQDLFEDYGLLTDFSKVSINLNPYRLRVDGLNQQLTNEELFIALKNIVKRRGISYLDDASEDGGTVSSDYGKAVEENRKLLAEKTPGQIQLERFEKYGQLRGDFTVVENGEKCRLINVFSTSAYKKEAERILRKQQDFNNQITDEFIEDYLKILTGKRKYYHGPGNEKSRTDYGRYTTHKDSKGEYVTLDNIFGVLIGKCTFYPNEYRASKASYTAQEFNLLNDLNNLTVPTETKKLSEEQKKTIIEYAKSAKTLGASTLLKYIAKMIDTSVDQIRGYRVDVNNKPEIHTFEVYRKMQSLETISVGELSRNVLDELAHILTLNTEREGIEEAINTKLKDSFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKYAAMEKAAFQYNGKKELPDNIFHGHKELATKIRLWHQQGEKCLYTGKSIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLVDTRYSSRVVLNALQDFYKNHNFDTTISVVRGQFTSQLRRKWGLEKSRETYHHHAVDALIIAASSQLRLWKKQNNPLIAYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKAGKLVDFNPFEKYRQENGPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQFFRFWSRTGKDNPKSFEKHKIELKPYEKAKFEKGEELEVLGKVPPSSNQFQKNMQIENLSIYKVKTDVLGNKHFIKKEGDKPKLKF

SEQ ID NO: 734 - protein, 1140 aa, Artificial Sequence
  Cas9
MNGLVLGLDIGIASVGVGILKKDIGEIIHTNSRLFSAATADSNIERRGHRGGKRLTRRKKHRSIRLHDLFEDFGLLTDFSKVSINLNPYQLRVQGLDNQLTNEELFIALKNIVKRRGISYLDDASEDGGTVSSDYGKAVEENRKLLAEQTPGQIQLDRFEKYGQVRGDFNVVENGEKRRLINVFTTSAYSKEAERILRKQQEFNKKITDEFIEDYLTILTGKRKYYHGPGNEKSRTDYGRYTTKKDPEGKYITLDNIFGILIGKCTFYPDEYRASKASYTAQEFNLLNDLNNLTVPTETKKLSEEQKKTIIKYAKTAKTLGASTLLKYIAKLIGASVDQIHGYRIDPNKKPEMHTFETYRKMQSLETISVEELPRKVLDELAHILTLNTEREGIEEAINATLKDTFSQDQVLELVQFRKNNSSLFSKGWHSFSLKLMMELIPELYETSEEQMTILTRLGKQKSKETSKRTKYIDEKELTEEIYNPVVAKSVRQAIKIINEATKKYGIFDNIVIEMARENNEEDAKKEYIKRQKANLDEKNAAMEKAAFQYNGKKELPDNVFHGHKELATKIRLWHQQGEKCLYTGKNIPISDLIQNQYKYEIDHILPLSLSFDDSLSNKVLVLATANQEKGQRTPFQALDSMDDAWSYREFKSYVKDSKLLGNKKKEYLLTEEDISKIEVKQKFIERNLVDTRYSSRVVLNALQDFYKEHQFDTTISVVRGQFTSQLRRKWGLEKSRETYHHHAVDALIIAASSQLRLWKKQNNPLISYTEGQFVDQVTGEIISLSDDEYKELVFKAPYDHFVDTLKSKKFEDSILFSYQVDSKYNRKISDATIYATRKAKLDKENKEYTYTLGKIKDIYALGTKSPSKTGFYKFLDLYNKDKSQFLMFQKDRKTWDEVIEKIIEQYRPFKEYDENGKEVDFNPFEKYRIENGPIRKYSKKGNGPEIKSLKYYDNLLGKFVDITPSESKNPVALLSLNPWRTDVYYNTETSKYEFLGLKYADLCFEKGGAYGISEVKYNKIREKEGIGKESEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGEEPKLKF

SEQ ID NO: 735 - protein, 1140 aa, Artificial Sequence
  Cas9
MEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKGKEGGAVLKATTENQKIMQEKGYRTVGEMLYLDEAFHTECLWNEKGYVLTPRNRPDDYKHTILRSMLVEEVHAIFAAQRALGNEKATEELENAYVEIMTSQRSFDMGPGLQPDGKPSPYAMEGFGDRVGKCTFEKDEYRAPKATYTAELFVALQKINHTKLIDEFGTGRFFTEEERKTIIDLLLSGKELKYGTIRKKLNIDPSLKFNSLNYSAKKEGETEEERVRDTEKAKFASMFWTYEYSKCLKDRNEEMTVGQKADLLDRIGEILTAYKNDDSRSSRLEDLGLSREEIDGLLELSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFGGGYDIDHILPYSITFDDSYRNKVLVTAQENRQKGNRTPYEYFGADEKHWEDYEARVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAAMNGKIASDWKTMEDNNFVFSLYSRDLIHVKRKKAIPTILSSGATFEQEEFYAYFTGADISTVSIAGISNDNSFKFRGLGIQGLEIFEKCQVDILGNISVVRHENRQGFH

SEQ ID NO: 736 - protein, 1141 aa, Artificial Sequence
  Cas9
MYSIGLDIGIASVGYSVIETNSGRIVELGARIFEARNSDNNKDRRDFRGGRRLIRRRKTRLDDAKRYLDDQGFKNDKSLINVCPYSLRVKGLTEELSKSEIRKVILHILKKRGVSYLSSEDLDTSSVDNKDSFKQAVTKNLRQLDDKTPGQIQYERLQESGRVRTGINQNGQYQLNVFDVASYAKELKLILETQQQYHQEIDDHFLDFFTKDGYREDAGLIYRKRPYYDGPGNAAQNSSYGRWANYQVDGKPAENIFDQLIGKDFTGKIRASNLGPSAQKFNLLNDLNNLRITTREEEKLTFEEKQEILEVLENDRPKTFGPRNIAKMLKVDMDDIKGWRLNSSDKPEIHTMKEYNDMRLVLEAGGFDIKAIDLDHIEEIASLITLNTEREAFELSLSNEIDNNLKQFLVENFNALRKCKPNNSWHSFSKENLQRLITELEHTSDEQNTILERLGLKFDLRSKYSDRDTLPIHEVLEEIYNPTVSKSVRQTFRVLNALVKKYGKENIDYVTIEMPRDKNEDDQKKTIREIQKVNKNRKDKSKEYFLKKSGWSEEKFEEKLRTSRRFASKLYYFYEQDGLCAYTGQQIQPEDLLTERVEVDHIIPLSVSLDDSINNKVLVTSEANQKKGQRSPYDAFMSGDFSKYRTYDEYKAWVLSNKYKKYKKALLLEERNIFDPELAKKFRQRNLNDTRYASRIVLNAVQSFFYKTDTKTRVVNGAFTHTLRKKWNLADKDRETHHHHAIDATLVAVTPFVKAERYEYYKDSEGKASMVDTVTGTIIPYSEYKKKNLYDRSNYLLMFGNESTINQEKEDKSAEFIRNLIPAKIYPEIKFSHQVDRKSNRRLSDATIYSTRSYTVEKGRGKNKREVIERDIIGKIKDIYTADGYAEYVKYKDSLLVKEIDEKTFEKLEAIIEEFSDTVEVTDQQGKVKKVSKSPFLQYCEKYDVPGVTKYSKKNNGPVIRSLKYRYTKLRSHIDISPKNSKNTVALLTLAPWRTDVYYSQETASYHLLGLKYIDLSFRDGGYGVSRKRYEEIKKNERIPEDGEFKFSLYKKDYIEIEFDKKILPGLYQSRDVSARNKFSMKPIDKAQWTSKEDVLMFGNVKASGVFEKTLKKNYVLRKYHVDVLGNKFEVKDEILKDILE

SEQ ID NO: 737 - protein, 1142 aa, Artificial Sequence
  Cas9
MYSVGLDIGIASCGYSIINDVNGNIVELGTLLFKSRNSDNNEERRTNRGSRRLINRRRTRLDDGKKLLAEKGFKQDSKLKHVCPYELRVKGLHEKLTQGEIYKVVLHILKKRGISYLDESDENSSGIDGASYKDQVNLNLNLQKELTPGQIQLKRLKENGRIKSGVTFENGYQLNVFSVSAYANELNKILTKQSEYYSEIDQIWIDRFTKNGYRKEAGLVYRKRPYYDGPGNEKNNSIYGRWANFKEDGHPKENIFDQLIGLDSVDSTQVRASASTLTAQKYNLLNDLNNLTIIEDDRKFTTDEKVSIINYLMTQDITRFGPKELAKFYQLEVDQIRGWRIDNKGNPEIHSLKVYRDWKKIFNTSSIDLTSIQTWVVDELANVITLNTEIPSTLATLKIKIPDIDQQILNFVENNFYELKKKTSKNSWHSFSLKTLNILIPELLNTSEEQNTILERLNLKFDLKNKYAEKNQIPVKELLEQIYNPTVTKSVHQSIKLFNEIIEKYGKNNISYVTIEMPRDKNDQDQKDTIKRINKLNSERKNDSEKYFLERSGWDTIRFESALKKPRFAEKLLFYYEQKGKCAYSGQDILAESLLNESCEVDHIIPLSISFDDSIHNKVLVTASSNQEKGQRTPYMAFIDGAKLGQSWDDFVAWVNSCGFHRKKVQNLLYEENIFNPDVQRGFVSRNLNDTRYASRIVLNAIQSFFYKQKDLTKVKVVNGSFTHTLRKKWGSSLDKNRDTYHHHAVDATLCAVTPFINIVKYEFFEEDGIKYMVDLTTGEKVAYSDYKKMKFYDKRAYVPIWDGFIKQLTPANLYPKIKFSHQVDSKWNRKISDATIYSTRKIVETKINKKGVAKETVKDIVIDKIKDIYTPEGWRKFKEKQDKLLMKNFDEKTYNKLIKIAKEYPEKKEVQTSNGKVSLVEVSPFKMYCEEQNVPAIRKYSKKGNGPYIRSLKFYDKELGKHINITKDSYGNDIERTIRNKKIILKNQNSWRTDVYYNSVNNCYELLGIKYCHLKFYRGKYGIPKSIYDELKKEDEISSESVFKFSLYRHDRVRFEKDGEYIEALFGSKNESNKNYLELSPIDKNKWLSKENVKFFGEVAASGRFIKGLKPGIKVIKQSTDYMGHVYAIHQEKLKFVLSDA

SEQ ID NO: 738 - protein, 1144 aa, Artificial Sequence
  Cas9
MTSKQEKHGALTFGLDIGIASVGWAVLGESRIVDLGVRCFDKAETAKEGESLNLTRRMARLLRRRLRRRAWRLTKLARLLKREGLIADANLFKHKIEKNTPVPKSSWQLRVDGLDRQLNAEEWARVIYHLCKHRGFHWISRAEEKAAEGDSKGEGGKVKQGLAGTKKLMQEKSYRTAAEMVLAEFPDAQRNKQGDYSKALSRILLGDELKALFEHQRKLGNPVATEKLEAAILGNGDKKCGLFWAQNPALAGNKLLEMLGRCTFEKTGGDDGKGEYRAPKASFSAERHVWLTHLNNLRIVVDGTTRPLNEAERRVALPMPYQQAGDLSYKQLGGALIKEGFLQKDGFKFAGLPYPTKQASEEKAKDPETSVLCKLPAWHTLRKTLEKHGLESEWQKLSTDALDGKPQLLDNIAWVLSVYKDDDEVKTELGKLNLPNTEKMIDALLDIRFDKFSNLSLKALSKIVPFMEQGQRYDEAVANIPEYGHHSQLHKVGAGEHKYLPPFYKERDKTGRMVFNDDMDIPRNPVVLRALNQARKVVNALIKEYGSPHEVHIEMARDLSRPLDERRDIEKLQKEFGERNKKDKELFAQDFNIVGTVKGKQFEKYQLYREQQGKCIYPSMDEKQGICCYSLKPLDLHRVLYEEGYAEIDHALPYSRSFDDSKNNRVLVLAKENRDKGNRTPFEYLGDKDNSEPWRQFVAFVEGNKAYRLAKRSRLLRKDFGDKEAKEFRERNLNDTRYICKFFKNYVEQYLQLHEDSEAKRCVVLSGQMTSFLRARWGLVKVRGDSDRHHALDAAVVAACSHGMVKRLSDYSRRKELEQVREGFVDVDTGEIVNPAMFQQVQEHFPNPWPHFRDEVKLRLSIDDPTLLRSEMEKFGTYTPESLEALRPLFVSRAPQRRNSGAAHKDTIYAQPKRLVAQGGVTQKVALSSLTLKDLDKLIDPHRNERLYAAIRARLEQHGGKGDKAFPASNPLRKPDSEGNPTGPIVRGVTMVIDKLSGIPIRGGIAKNDSMVRVDVFTKANKFHLVPVYVHHSVLGLPNQAIVGGKEESEWTQIDDSFDWHFSIYPNDLIRVTLKQEGRFGYYAGCDRSTAAIHLWAHDRNQQVGKDGLIRSIGVKTALSIEKFNVDVLGNRYPAPPEKRRDLA

SEQ ID NO: 739 - protein, 1144 aa, Artificial Sequence
  Cas9
MTSKQENLGALTFGLDIGIASVGWAVLGENRIIDLGVRCFDKAETAKEGESLNLTRRMARLLRRRLRRRAWRLTKLARLLKREGLIADANLFKHKIEKNTPVPKSSWQLRVDGLDRQLNAEEWARVIYHLCKHRGFHWISRAEEKAAEGDSKGEGGKVKQGLAGTKKLMQEKSYRTAAEMVLAEFPDAQRNKQGDYSKALSRILLGDELKALFEHQRKLGNPVATEKLEAAILGNGDKKCGLFWAQNPALAGNKLLEMLGRCTFEKTGGDDGKGEYRAPKASFSAERHVWLTHLNNLRIVVDGTTRPLNEAERRVALPMPYQQAGDLSYKQLGGALIKEGFLQKDGFKFAGLPYPTKQASEEKAKDPETSVLCKLPAWHTLRKTLEKHGLESEWQKLSTDALDGKPQLLDNIAWVLSVYKDDDEVKTELGKLNLPNTEKMIDALLDIRFDKFSNLSLKALSKIVPFMEQGQRYDEAVANIPEYGHHSQLHKVGAGEHKYLPPFYKERDKTGRMVFNDDMDIPRNPVVLRALNQARKVVNALIKEYGSPHEVHIEMARDLSRPLDERRDIEKLQKEFGERNKKDKELFAQDFNIVGTVKGKQFEKYQLYREQQGKCIYPSMDEKQGICCYSLKPLDLHRVLYEEGYAEIDHALPYSRSFDDSKNNRVLVLAKENRDKGNRTPFEYLGDKDNSEPWRQFVAFVEGNKAYRLAKRSRLLRKDFGDKEAKEFRERNLNDTRYICKFFKNYVEQYLQLHEDSEAKRCVVLSGQMTSFLRARWGLVKVRGDSDRHHALDAAVVAACSHGMVKRLSDYSRRKELEQVREGFVDVDTGEIVNPAMFQQVQEHFPNPWPHFRDEVKLRLSIDDPTLLRSEMEKFGTYTPESLEALRPLFVSRAPQRRNSGAAHKDTIYAQPKRLVAQGGVTQKVALSSLTLKDLDKLIDPHRNERLYAAIRARLEQHGGKGDKAFPASNPLRKPDSEGNPTGPIVRGVTMVIDKLSGIPIRGGIAKNDSMVRVDVFTKANKFHLVPVYVHHSVLGLPNQAIVGGKEESEWTQIDDSFDWHFSIYPNDLIRVTLKQEGRFGYYAGCDRSTAAIHLWAHDRNQQVGKDGLIRSIGVKTALSIEKFNVDVLGNRYPAPPEKRRDLA

SEQ ID NO: 740 - protein, 1145 aa, Artificial Sequence
  Cas9
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKCHYLKMVNL

SEQ ID NO: 741 - protein, 1146 aa, Artificial Sequence
  Cas9
MSGNTHGPLTFGFDIGIASVGWCVLGENRIVNLGVRCFDKAETAKEGESLNLARRTARLMRRRLRRRAWRLTKLARLLKREGLIAEASRIHIPSPVSPWRLRVEGIDRRLTDDEWARVIYHLCKHRGFHWISRAEERKAESDAKEGGRVKKGLSDTQRRMTEKGYRSAAEMVLAEFPDAQRNKQGDYGKALSRILLSDELALLFRRQRELGNPNAGNELEATILGNGNRKSGLFWEQKPPLAGADLLKMLGRCTFEKNEYRAPKASFTAERHVWLTRLNNLRVVVDGTTRSLDDAEHRLVLPLPYKQAGDFTYKQLRTALTKAGLLPEGFKFAGLSYPTGRQLDDPKAKDPESEKLVRLPAWQELRKTLKDKNLETEWEGMAGAATGGNPELLDEIARVLSVFKDGDEVTAELWKLPLPGGKAMIDALSEISFDKFHALSLKALRKIVPHMESGLRYDEACAVAGYHHSQLHAAGAGEHKFLPPFYSRRDKDGRMVFNEELDVPRNPVVLRALNQARKVLNALVRTYGSPTAVHIEMARDLSRPLDERNKVKKAQDEYRERNEKDKAAFAAEYGIAPKSREFEKFQLYREQQGKCAYSLKSLDLHRVLHDIGYAEVDHALPYSRSYDDSKNNKVLALTEENRNKGNRTAYEYLTSFPGGENGERWRNFSVAVETNKAYRLAKRTRLLRKDFSGRAAEEFRERNLNDTRYICRFFKNTVERFLKLDAKVGAGDTAEISAKRCVVLSGQTTAFLRARWGLLKVRGNSDRHHALDAAVVAACSHGMVKRLGDYSRTKELAKVHDGFPDPETGEIIDPVMFQQLHAHFPDPWPHFRAELEARLNVDDTADLRARMELFGTYAPEALETLRPLFVSRAPQRRNSGAAHKDTIYAQPERLKEQGGVTQKVPLTSLTLKDLDKLIDPHRNEKLYAAIRARLEAHGGKADKAFPAGNPLRKPDREGNPTGPVVRTVTMVIDKLSGIPVRGGIAKNDTMLRVDIFRHKKDGKFHLVPVYVYHAVAKEFPNRAIVQAKDEDEWTLIDDKFDFCFSAHPNDLLKITQKSGETIFGYYRGCHSGTAAINIALHDRYAYAEKTTSLAFSKKNPGKPIPNDKLGLIEGIGVKMAANMEKFHVDTLGNIYPAPPEQRRGLA

SEQ ID NO: 742 - protein, 1146 aa, Artificial Sequence
  Cas9
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 743 - protein, 1146 aa, Artificial Sequence
  Cas9
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRNAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKDGKYYFVPIYVADVLKRELPNRLATAHKPYSEWRVVDDSYQFKFSLYPNDAVMIKPSREVDITYKDRKEPVGLRLMYFAGADISGATLTLRTHDNSGELKGLGIQGLEVFEKYVVGPLGDTHPVYKERRMPFRVERKMN

SEQ ID NO: 744 - protein, 1148 aa, Artificial Sequence
  Cas9
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEAYPSMYHLRLRLMTDASQADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHNEDLELFKTYLKKLNDHELAKTIRVIYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAKSGENVFAWMVRKDPSGNITPYNFDEKVDREASANVFIQRMKTTDTYLIGEDVLPKQSLLYQKYEVLNELNNVRVNNEALGTDQKQRLIREVFERHSSVTIKQVADNLVAHGDFAQRPEIRGLADEKRFLSSLSTYHQLKEILHGAIDDSTKLHDIENIITWSTVFEDAAIFKTKLAEIDWLDAATIKKLSNIRYRGWGQFSRKLLDGLKLGNGQTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFTSTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYAKLAPFFTYGEFAKVDVKKFREFNFIGALKHAKKNIVAKDTGEIVWDKERDIQELDRIYNFKRMLITHEVYFETADLFKQTIYAAKDSKERGGSKQLIPKKRGYPTQVYGGIHGKIRLTWRWLKLLRRKKMSIELSELQLLK

SEQ ID NO: 745 - protein, 1149 aa, Artificial Sequence
  Cas9
MERYHIGLDIGTSSIGWAVIGDDFKIKRKKGKNLIGVRLFKEGDTAAERRGFRTQRRRLNRRKWRLKLLEEIFDPYMAEVDKYFFARLKESNLSPKDSNKKYLGSLLFPDISDSNFYDKYPTIYHLRRDLMEKDKKFDLREIYLAIHHIVKYRGNFLEKVPAKNYKNSGASIGFLLEEVNDLYGNIIGNEDVAILDNDKFEDVEKIILNDEIRNIDKQKNVGRLLVKDKKEKNIVTAFSKAIFGYKFNLEDLLLIESDEKNKLTFNDENIDDIFNELSHSLNDNQMDLLTKTREIYFKFKLNMIVPTGYTISESMIEKYEMHKAHLKMYKEFINTLNAKDRKILKNAYSDYINNEKAKAANAQENFYKTVKKTIKENDSDTAKKIIGLIDEGNFMPKQRTGENGVIPHQLHQIELDRIIENQAKYYPWLAEENPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKYKVLNELNNIKVNKKKLDVEQKQHVYLDLFTTRKNVTKDDLATSLNCDVESITGLTDNKKFNSSLSSYIDLKAILGNIVDDYSKNEDLEKIIEYSTIFEDGNIYKEKLSEISWLTDEQIEKLSNIHFKGWGRLSKKLLTQITNENGERIIDTLWNTSNNFIQVISDESIQAKLAEINGEYANKYNLEDILDEAYTSPQNKKAIRQVMKVVEDIEKAMKCEPTSIAIEFTREKRKSKLTNTRYKKISETYEKITDELISEYELGKLQSELDSKVNNMRDRYYLYFMQLGRDMYTGEKMNIDELHQKYDIDHILPQSFIKDDSLNNRVLTSKSVNIKEKSDKTAADLYAAKMGDFWRKLRKQGLMTEQKYKNLLTRTDSINKYTKQSFIKRQLVETSQVVKLAANILQDKYRNTKIIEIRARLNSDLRKKYELIKNREVNDYHHAIDGYLTTFVGQYLYKVYPKLRSYFVYDDFKKLDSNYLKHMDKFNFIWKLEDKKAEDVYDKVNDEFVLNVPEMKEYIRKIYNYKYMLVSKEVTTKNGAFYDQTKYNAKTINLIPIKKDKPTNIYGGYKGKVSSYMMLVKIQKKKEVIYKFVGVPRLWTDELDRLIDTDEKKALLKK

SEQ ID NO: 746 - protein, 1152 aa, Artificial Sequence
  Cas9
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 747 - protein, 1153 aa, Artificial Sequence
  Cas9
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 748 - protein, 1157 aa, Artificial Sequence
  Cas9
MNYYNGFIITENAMTSKQEKHGALTFGLDIGIASVGWAVLGESRIVDLGVRCFDKAETAKEGESLNLTRRMARLLRRRLRRRAWRLTKLARLLKREGLIADANLFKHKIEKNTPVPKSSWQLRVDGLDRQLNAEEWARVIYHLCKHRGFHWISRAEEKAAEGDSKGEGGKVKQGLAGTKKLMQEKSYRTAAEMVLAEFPDAQRNKQGDYSKALSRILLGDELKALFEHQRKLGNPVATEKLEAAILGNGDKKCGLFWAQNPALAGNKLLEMLGRCTFEKTGGDDGKGEYRAPKASFSAERHVWLTHLNNLRIVVDGTTRPLNEAERRVALPMPYQQAGDLSYKQLGGALIKEGFLQKDGFKFAGLPYPTKQASEEKAKDPETSVLCKLPAWHTLRKTLEKHGLESEWQKLSTDALDGKPQLLDNIAWVLSVYKDDDEVKTELGKLNLPNTEKMIDALLDIRFDKFSNLSLKALSKIVPFMEQGQRYDEAVANIPEYGHHSQLHKVGAGEHKYLPPFYKERDKTGRMVFNDDMDIPRNPVVLRALNQARKVVNALIKEYGSPHEVHIEMARDLSRPLDERRDIEKLQKEFGERNKKDKELFAQDFNIVGTVKGKQFEKYQLYREQQGKCIYPSMDEKQGICCYSLKPLDLHRVLYEEGYAEIDHALPYSRSFDDSKNNRVLVLAKENRDKGNRTPFEYLGDKDNSEPWRQFVAFVEGNKAYRLAKRSRLLRKDFGDKEAKEFRERNLNDTRYICKFFKNYVEQYLQLHEDSEAKRCVVLSGQMTSFLRARWGLVKVRGDSDRHHALDAAVVAACSHGMVKRLSDYSRRKELEQVREGFVDVDTGEIVNPAMFQQVQEHFPNPWPHFRDEVKLRLSIDDPTLLRSEMEKFGTYTPESLEALRPLFVSRAPQRRNSGAAHKDTIYAQPKRLVAQGGVTQKVALSSLTLKDLDKLIDPHRNERLYAAIRARLEQHGGKGDKAFPASNPLRKPDSEGNPTGPIVRGVTMVIDKLSGIPIRGGIAKNDSMVRVDVFTKANKFHLVPVYVHHSVLGLPNQAIVGGKEESEWTQIDDSFDWHFSIYPNDLIRVTLKQEGRFGYYAGCDRSTAAIHLWAHDRNQQVGKDGLIRSIGVKTALSIEKFNVDVLGNRYPAPPEKRRDLA

SEQ ID NO: 749 - protein, 1161 aa, Artificial Sequence
  Cas9
MKKILGLDLGSASIGWALVEETEQMQYNIVSLGSRIIPYNGTEGQEFEKGTGESRNSLRTKARTARKGYDRYQLRRKNLEKILLQNGMYPNEQVRALQKLELWKLRADAPNVQISLPELGRLLFWLNQKRGYKSSRSDANLDKKDTEYVATVKSRHQKIKDAGQTVGQYFYGQILENEYHRIKEQVFPREAYIEEFDAIVARQKEYYPTILKQELIDKIRNEVIYFQRGLKSQKGLVSVCEFEGREFNGHFGGPKVAPKSSPIFQLGKIWENINNIKIADIELTAEQKLVFFNYLNCHERITEAKIRELLKLSKDSRLNGQLKNGLTGNKTYSQIASCFGNKIGEYERLFKFELEVIESEKLEYTYHPKSHIPVGEKRRKYISENVEKEPYYRLWHTIYSIKDKDECRAALIKNFGIEEEIAEKLASLDFSAGGFGNKCAKVIRKILPYLMEGDKYNVAMDYAGYNHSFSQTKDENLQRVLLDSINHLPKNSLRQPIVEKILNQMINLVNEVIKQWGRPDEIRVELARKLKQSKTERNDDDNFMRKRERENEIIKADLAKYGLKATRNNVIKWRLYHEIDDKDKKLNARCIYCGQPISLTEAILGNNVDVEHIIPKDKLFDDSQSNKTLAHRSCNSGKGNKTAYDFMKDKPQFEEYVARVEELYKKHLISLTKKRKFLMSEDKIPSDFIDRQLRESQYIARKSREILQTVCRNVWSTDGGVTAHLRKLWGWDDVTMNLQMPKYKGIGMTEIVEWESNHGKNQHTQEVIKDWSKRDDHRHHAIDALVVACTRQGYIQRINTLNSSETKDEMHRKVAGSLVEFNQKHTLLNKYLITEKPFTTSEVEDVVSKILVSFKAGKKAATPGKRKVGKRGNKQVVQDGIIIPRGALHADSVSGSIKQYDPTGNFENHNVIKYKVGVGKGYLFDGKDDKKKIDKTIDCIVDKKIRDLIKQRAEESNYSLKKMFETPILFNQRAVFSVRCKTGNKAVVPIRNGYVVPDNNHHTAIYKYDGGLKEQCVSLMQAIERKRYNLPIIIKNPKEIYDKITEIANINQLLFDSLPKLDWEFVTTLQKNDMFILGMDYSATEEALADGNYRLLSEYLYKVQNISDGIYRLCHHTITKFDLSKANKPDKRFYNIQSLKAWNTLNPQKVKINILGQIERQ

SEQ ID NO: 750 - protein, 1166 aa, Artificial Sequence
  Cas9
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 751 - protein, 1168 aa, Artificial Sequence
  Cas9
MARPAFRAPRREHVNGWTPDPHRISKPFFILVSWHLLSRVVIDSSSGCPFGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 752 - protein, 1170 aa, Artificial Sequence
  Cas9
MSKYNVGLDIGIASVGWSIVDADKKKIIDLGSRIFSSGNAAANQERRGFRGTRRLIRRRKNRLTDVINFFGEKKFIDTKVVDKNGHVHYKFSVNNTESPYELRVKGLSEILTKQELVIALYHIVKHRGISYDLGDLEDDGTSGVTDYKTSININRQLLNEKTVGQIQLERLNEFGKVRGQVEENENVTLLNVFPSAAYVKEATQILTKQREFYPEITDDFIAKFMLFITRKRDYFVGPGNEKSRTDYGIYKKDGRTLDNLFDELIGIDKINGEKRASASSLTAQIYNMLNDLNNLTVPNTEDGRLTIQTKKEILEAAKTTNGLFGIAQICKIIGCKKDDIKGFRIDKSEKKIMHTLSGYRKFRKELADVNIEANDLNINLVNKIADILTLNTEKAEIRKQLDKSNMDISNEMKEIVINKNKEFLVDGRATWHSFSYKTLNLLIPELLNTPEEQMTILTRLGLVKPNNKKYEGLKNIPARRITEEIYNPVVARATREAVNVFNAITKKVGRDNIKDVIIELPREDNEVDIKKGIVKRQKQNEVEKETADALVKQHMTISDSALIAQYRKIRGLSQKVRYWYQQDTICPYCGKKIEAVQLINNNDSFEVDHIVPISVSFDDSQNNKVLVHSQCNQAKEKQTPLGWLNNGGGFGQSKADYIARVKSNKNYAKNKIDNLLNETDLNDIATQRGFIQRNLNDTRYASRIVLNEFYSFFRSNNLSTKVKVVRGKWTSQMRKKWNGVGGLSKTRDTYHHHAIDACIIACPFLLKAFDKAIKLIDVDGETGEILQDKKAIKLAQEAEIVEKISVIKNKKFENMVNEIYNFPLFKQVELANDITNLENPVKFSHHVDKKANRAVANQTIYGTRIKEKEVTKRGKKEKIQERYTLGTIKNIYDIDGFMNFKKLYDKISKNDDVKFLMQKNDPKTWEKLIDIFNSYPDSEEVTQVDGKVKRVAVSPFKLYYRENGFITKYSKHNDGPKVVSIKYYDSKVGSHIDITPKDARNKVILQSLKPWRTDVYFNSITQQYELLGLKYSDLKFTNGVYGITRDAYEKLKHGVSEDGVTAWKPISKNSEFRFSLYRNDRVRVIDEKGDSIELLFASRTTSNEGYVELKPIYKAKFDSKEEVGFYGLVSNGRLIKKMSKGGYKLYKVNTDILGKPYYVTRESDEPKLSL

SEQ ID NO: 753 - protein, 1171 aa, Artificial Sequence
  Cas9
MAKYSVGLDIGISSVGWAIIDIETKQIVNLGSRIFPSGNAAGNQERRGFRGIRRLIRRRKNRLTDLKKLLGETFFSDLKKIDSNGYEYYDIDFQINANPYELRVKGITEKLSKKELAVVLHHIIKHRGISYDLGDLEDDGTSGVSDYKNSININRQLLREKTVGQIQLERLIEFNQVHGQVKKAEDVSLLNVFPSSAYRDEANKIMIKQQEFYSEITNSFMEQVDQLVSRKRDYFIGPGNEKSRTDYGIYKSDGRTLDNLFAELIGTDKINGEKRASASSLTAQVYNLLNDLNNLHVSNTEDGKLTTSTKKEIIKAAKTTDGVFGISQICKIIGCKKEEITGFRQDKSEKKVIHTLAGYRKIRKALATINIEANELNPTVFDQIADILTLNTEKAEIRKQLDKVQLDITDEMKELVIDKNKDFLVDGRATWHSFSYQTLNMLIPELLNTSEEQMTILTRMGLMKSDNEKYRGLKKIPAEKIASEIFNPVVAKSTREAIKVFNAISKEIGKNNIEHVVIELPRDDNEEDEKRKIQKLQKANETEKEAADNLVKHKLGISDSALIAHYRKFKGLSQKVRYWYQQETYCPYCGKIIEATQLINNNDNFEVDHIIPISVSYDDSQNNKVLVHSQCNQAKEKQTPLGWINNGGGFGQSKNEYTNRVKNNKKYSKNKVDNLLNETDLTDIITQRSFIQRNLNDTRYAARTVLDEFYSFFKSNDLPTKVKVVRGKWTSQMRRKWNNVGGLRKTRDTHHHHAIDASIIASFPLLRAFDRAIKLIDVDKETGEIVQYGKASLNGDVIEEKSVIQAPIIKNEKFEKLVDEIYNFPLFKQVELANNIENPENPVKFSHHVDKKANRTVANQTIYSTRIKKTEKIVRKKVTAKEEEYVIGTIKDIYDVTNFEKFKKLYDESSKKDDIKFLMQKNDPKTWEKLVEIMNTYPDYEEISQLDGKVKRVKVSPFKLYFRENGFITKYAKHNNGPKVVSIKYYDSKLGNHIDITPVNANNKVILQSLKPWRTDVYYNNETQQYELLGLKYSDLKFTKGVYGITREAYEKLKYGYTDGVPAWKPISKESEFKFSLYRNDRVRIINEAGEKIDLLFGSRNETSEGYVEMKPIFKTNFDDAEEASFYGKTSNKRLIKKMARKGYQIYKVNTDILGNLYYTAKESNEPKLDL

SEQ ID NO: 754 - protein, 1172 aa, Artificial Sequence
  Cas9
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKNCKRKNSKTKNYQRTCGNKNNGTR

SEQ ID NO: 755 - protein, 1173 aa, Artificial Sequence
  Cas9
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 756 - protein, 1174 aa, Artificial Sequence
  Cas9
MGKYSIGLDIGISSVGWSIIDIEKKKIVDLGSRIFPSGNAAANQDRRGYRGTRRLIRRRKNRLADVINFLGEENFIDTKVVDQNGNIHYKLLVNSTESPYKLRVKGLSKMLTKQELVIALYHIVKHRGISYDLGDLEDDGTSGVTDYKTSININRQLLIKKTVGQIQLERLKEFGKVRGHVKKDENITLLNVFPSSAYVKEATQILTKQREFYPEITDDFITKFIPFISRKRDYFVGPGNEKSRTDYGIYKKDGRTLDNLFDELIGIDKISGEKRASASSVTAQIYNMLNDLNNLTVTNTEDGKLTTQTKREIIEADKTTNGLFGITQICKIIGCKKDDIKGFRIDKVEKPIMHTLSGYRRFRKELAKINIEANDLDINLVNKIADILTLNTEKAEIRKQLNKSNIDVSNEIKELIINKNKDFLVDGRATWHSFSYKTLNLLIPELMNTSEEQITILTRLGLVKSNSEKYKGLKNIPARRITEGIYNPVVAKATREAVNVFNAIAKKIGRDNISDVVIELPREDNEADIKKGIVKRQKQNELEKEAADALVKQQMTISDSALVAHYRKVRGLSQKVRYWYQQGTCCPYCGKNIEAVQLINNNDSFEVDHIIPISVSFDDSQNNKVLVHSQCNQAKGKQTPLGWLNNGGGFGQNKTEYVAKVKTNKNYSKNKMDNLLNDMDLSDIVTQRGFIQRNLNDTRYASRIVLDEFYSFFKSNNLSTKVKIVRGKWTSQMRKKWNGVGGLKKTRDTYHHHAIDASIIASFPLLKVFDKAIKLIDIDRETGEILQDKEAIKMSQEAKLLEKIPVIQNEKFEELINELYDFPLFKQVELANDITNPENPVKFSHHVDKKANRSVANQTIYGTRIKEKEINKRGKVEKVQERYILGTIKNIYDIDSFTSFKKIYDKMSKTGDVKFLMQKKDPKTWGKLVEILNSYPDSEEITQVDGKVKRVKVSPFELYRRENDFITKYAKHNDGPKIVSIKYYDSKIGSHIDITPINAKNKVVLQSLKPWRTDVYFNSETRQYELLGLKYSDLKFTNGVYGITSEAYEKLKHGISEDGTKTWKPIGKNSGFRFSLYRNNRVKIVDEKGESLELLFASRTTSNEGYVELKPIYKSKFDSKEDVGFYGQMTPSGQFVKKMARVGYKLYKVNTDVLGNPYYITKESDDPELSLYKK

SEQ ID NO: 757 - protein, 1175 aa, Artificial Sequence
  Cas9
MEEMKQTGRKNEAPKLTDLNYRIGLDIGIASVGWAVLENNSHDEPFRIIDLGVRIFDTAEQPKTGASLALPRREARSARRRIRRRRDRIERIKKLFQAEGLINIDEFEARYKIAGLSDVYKLRYEGLDRKLTDDELAQVLLHIAKHRGFKSTSKAEEAENENDAAKKKEAGALKKGISNNKKLMEEKGYRTVGEMMYLDENFRTDCPWNENGYILTPRNKSGDYKHTVLRDMLVDEVREIFKSQRSLGNIHASEELENAYLDIMLSQRSFDMGPGAPSKYAMEGFEDRVGLCTFEGKNGEKRAAKAAYTSELFVALEKINHTKIVSDDGATRFLTTYERKSIIELMHKQQTVKYAAVRKAIGLAEEDKFYNLNYSPKAGSKKSPEDTDFVKLENYHKIRKALGEDIVSEHLPAEKIKLYDSIATILTLFKNDDSRIKRFIELGIGEECFDGLLSLSPSKFHNLSLVAMGKIIPFLLDGNTYDKACELAGYDFKADNKGEKSVLLKGKNITDMVNDITNPVVRRSVSQTIKVINAIILEYGSPQAVNIELAREMSKNFDERRKLKSDMESREKENNNVIKRVKEYKLNPTGQDIVKFRLWEEQDRRCLYSGEKIDINDLFSRDGGYDVDHILPYSITFDDTYRNKVLVKASENRQKGNRTPYEYFMAEKDDDEWNVYETLVRNTVKDYKKVLKLLKKHITEDEKSEFRERNLTDTKYITRIIYNMIRQNLVLKPYLSLEKERKKQVMAVNGSITHYLSKRWGLESKDRRTDTHHAQDAVVIACTTDGMINKISRYSKGRELLYSRGFKFVDEETGEILSRDNFTREEWDEKYGVKIPIPWEHFRDELDIRMSRYNGTGDDSIDKTTPRDFILSHRDAHKWINYPEWMFVEGRPGRRGVLDGIFVSRMPKHKVSGQAHEETVRSAKYYNDGGSVFESGGYVVTKKSIQDIKLKDGEIKEFFNPDSDRLLYNALVDRLNKFENDPKKAFAEPFYKPKADGTQGPIVKKIKVFEKQSSGVFVRDGKGIAANGAMVRIDVFCEEDKGKKKYYFVPIYTADVVKKKLPDRAATANKLISEWRVMKEENFIFSLYSRDLIYIESDKGVQVKDIDGKISKPVNLFAYYLGADTSTASISGKLHDSSANFRSIGIQGLRRFDKCQVDVLGNISFVNKEKRMPFN

SEQ ID NO: 758 - protein, 1176 aa, Artificial Sequence
  Cas9
MNKVQEDCYKKIKEKLADREYRIGLDLGVGSIGYAVVSLKGDMPEDVILAGSRIFKSSIGAAERRHFRAQRNTHRHHRERMRYLWKLLAEKNLALQLPENLSKKENFTDFDTSRKRFPIEVLRNDPYILRYKALDEKLSLFQLGYALYHIANHRGTASVRSFLEDDEAKVKENKETAKLAKNTKKIMYEKKYRTFGEYLYRERIEKFRQNERMKVTNKNENKEFAVTRDIIEKEVEMILGAQKRYNTAVLADDYIERIKKAIFYETEKLIPEPEYCPYFKDDKRLPRSHKLNEYRRIYEALNNTRYYIPEIEEKTGEILSRKEKEQLSKEEKEKLFNFLLKNKELTEAKVKKLLNLSEMAKVQLQGRDKKNQKIKGYALITLESLPFWSKLPEQQQDEFLYDWNKLPDEKLKDRLRNYYKLTDDEIDETFQNIVLPSNYAPLGKKAMEILLEYIKNGLSYIEALDKAADENKIKVEKHEINDLLPYYGKILQESTQMPIGKAFSKQFAAKNYKKPDINKNEQEFGRIANPVVHQTLNELRKLINEIITVFGKKPLEISLETSRELKKSQKERELIAKQQDIDEEKRKKIWKTYIEPHLQQIKSRSDKLKKLFVFELWEDQKHNCPFCLEKINVDDIYSRGVDKEHLFPLKKSEDDSENNLVIAHNKCNARKAERAPFDAFGHESIWNDIFSNAEKNLPRKLWRFRQGSFEKFLEKPPMLKRFETDNSYISKISARYLACLFDKPSKIFCVKPFLTAQLRIAWQLDEIMIRLAENIILDSEKDSFNKGGLQKKKRIDNRHHALDAVVIAYASRGYHNFLNRVHAKGYKINYDEKTWLSETLRPPGNKNLEDFKSGIINVMINANISIKHDHNNKGQLVKSKAYKLYYSEIGKYIITTLKSVSEILFKQKEKPQDTLRRALCKFEDRLSDIKDKKLRKKLEDNITIYKSIENESALSKAKQELEEFDLKAKKEGKKGYEKITDILIYKKACSMHGGKYIHVKNRIENKFFALKEPTEIETGFGYDTADNLSLDLYHDNNGKLCGEVIRKIDFNRNRVPNYKKEGYILLERIYQGDTLEVDISDDKISLKNKVGSAPDKRTFVKVLTFTESDRYLKNKRDQIQIFFCNLLKSTLKHDDSSKHDDSFYVSSMQKYNVRKVILTSLGIIKYRSKILKNKEI

SEQ ID NO: 759 - protein, 1176 aa, Artificial Sequence
  Cas9
MLFPKKLSKEEVAYVLVEINSNLNNSSNYLGNISDRSKELYFNKQTIGQFLYTKLKEDRHYSLKNKVFYRQDYLDEFERIWETQAIFHKELTEDLKKQIRDTIIFYQRRLKSQKGLISLCEFENKEITIEKEGKTVTKQIGVRVIPKSSPLFQEFKIWQILNNVICKKKGTRKKKAVTPAPLLFELFGTPSETFFSLDMECKQLLFEELNLKGNLKADKVIRLLGYIPQEWEINYNQLEGNRTQKSLYEAYLKIIEIEGYDIKTFLRIKSDKEDWDLEESPLSAKEIRENIQHIFETLGISTAILYFDATLPIKDFEKQASYQLWHLLYSYESDNSPSGNETLYKLLQDKFGFKREHAVFLSNISFQDDYGSLSAKAIRKIYPYIKENQYSTACELAGYRHSKLSLTKEELNNRPLKDLISPLKKNSLRNPVVEKGLNQMINVVNALIEKNSEKDAEGNIIKYFHFDEIRIELARELKKNAQERAEMTLNIKNATIEQEKIKSILISDFGIKNPTKNDITRYRLYQELAHNDYKDLYTNTDIPKELLFSKNIDIEHIVPKARVFDDSFSNKTLAYRDFNLKKGENTAFDFIDSSLGEEELNQYIARVENAFKTKNISATKYRNLLKKATEINDGFINRDLRETQYIAKKAKDLLFQITRSVVSTSGSITDRLREDWGLIDIMKELNMPKYRDLGLTEIIERRDGRKVEVIKDWTKRNDHRHHAMDALTVAFTKPSYIQYLNHLNARKDENNKLYADILGIERKETTKIHDENGNEKRVFIEPIPGFRQIAKKYLEEILISHKTKNKVVTKSINKIAGTNKKQETLTPRGQLHKETIYGKYHYYSNKEEKIGTKFDKETISKVSNPIYRYALQKRLEANENNPKKAFTGKNALSKNPIYLDDAKTKILPEKVNLIYLEEDFSIRKKIVSENPTSKEFVPNSISIEKIVDEGIKRILKERLETYNNDPKKAFADLDKNPIWLNKEKGISIKRVTISGVKNTQALHSKKDHLGKPILDKEGQEIPVDFVSTGNNHHVAIYRDQKGNLQEQIVSFFEAVVRAQQGLPIIDKTYKQEEGWQFLFTMKQNEMFVFPNEITGFNPSEIDLLDPKNKKLISPNLFRVQKISIKDYFFRHHLETNVETNNILKDITWKRGGLSLLKGIIKVRINHLGNIVSIGEY

SEQ ID NO: 760 - protein, 1177 aa, Artificial Sequence
  Cas9
MNKVQEIEYKKIKEKLADREYRIGLDLGVGSIGYAVVSLKKYDDLSYLPEDIILAGSRIFASSIGAVERREFRLQRNSHRHRRERMRFLWKLLAEKQLALQPSKDLEKKENSADCETSQKRFPINILKNDPYILRYKALDEKLSLFQLGYVLYHVANHRGTDSIRSFLEDTDDKIKENTKTAKLATETKKIIDSKKYRTFGEYLYKERIQQNERKKVSNRKTAGNKNKEFAVTRDMIFKETEKILASQKQYYTNVLTDEYIKEIEGAIFYQTEKLIPESGYCPYFKDEKRLPCSHKLNEYRRIYEALNNARYSAPVLDEKTGEILSYQEGEEFSSEEKKILFDEVLLKGKKLTESEIKKLLHLPDGCEIQLQGRDKRTQKIKGYALTALEALPFWSKLSQQQQDEFLYDWNGLPEEKLKPKLIDCYSLTENEVDETFQKIRLPSNYAPVGKKAMEILLTYIKDGYSYTEALDKAVSEGKFKVDKQTTIYDSLPYYGKILQESTQKLIGKAFSKQFAKRNYKKPNTNRNEREFGKIANPVVHQSLNELRKLINEIITVFGKKPLEIGLETARELKKSSKDRESLVKQQNENEYNRNKIYKDYVEPHLSQIKSRQENPSRYIFKFELFEEQKSICPFCLKEITPDDIINSKVDIEHIFPIEESEDDAKNNLVIAHNECNADKGKKSPFDAFGDKTSGKYVWNDILHNAKKNLPHKIWRFYQGSLEKFLENKPMLKRFGTDNSYISKIAAKYLACLFNNSSKIFCIKSSLTAQLRIAWELNSIMIPLAKNILSEKELEEFKTLKNKKIRMDNRHHALDAITIAYANRGYHNFLNKIHAKGYKIDYREKNWLSKILLPPLNRDLEDFKISVKNSIEKANVSIKHDHKTNGSLVKGTAYKVYYSGTGKYIITTLKNVEEISFKEKEDPEDTLRRALCGFEDSNIKDEKLIKKLKYNSDLYKKILNTKPKAKQELEQANQETKEEGKKTQKITDVLIYKKACSLVGEQYIQCASRLENKFFAVKEPTEIRTGIGYDTGDNLFLDLYYDKTRKLCGEIIRKIDFNQNKIPNYQKEGYILFERIYQGDTLEADTSEDKISLKNKTGSALDNRTFVKVLTFTESDKYFDGKKDKIQIFFGNLLKSNYKQDDSFYISSMQKYNVRKVILTSLGIIKYRSQILKNKEV

SEQ ID NO: 761 - protein, 1179 aa, Artificial Sequence
  Cas9
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 762 - protein, 1188 aa, Artificial Sequence
  Cas9
MKYILGLDIGVSSVGIAVISEENQKKTIENLAVRIVPEDPDFHGKFYSGNTASKNLERTAKRGNRKNNQRFKARRDKLYQSLKENNMFPTSNLFDLSAVELYGLRAKAVSEQVSLQELGRILILLNQRRGFLSNRKSVSEENSTEYKERIAGLEKALGNKTIGQKLYSELQENNNVFEVLLRERTYQRSSYTEEFDRIWDEQKKYYLILTGSSNEDDNKGTLYDLIRNRIIYYQRPLKSQKGLISECLFEKHHKAVAKSSPYFELFRIWQKINDLSWKTPNGELFKPTDEQKQKLKNALWNGDNLNPKHKLTVSKIKEILGYTSREKIYLNFTELDGSRTYSILRNALIEAGIEKPEQYLFFNMETNDEKGGLFELWHITYSLPIEKEVINALKNRFGFDKKQAEIIARRVGYSSDYGSLSTRAIRKLLVHLEKGLGYTDACDNIGYDHSGYKTKIDLQPKLKQLKRNELRNPVVEQILNQVVNAVNLIIEKYGKIDEIRVELARELRNNAKTRKNISLLNSKNKKNNDIIRKKLQEEYGFKFVNGRDVTRYILWEENSKECLYCNKTINGSDMLTGNADIEHILPKSRSFNNAMNNYIITHRKCNSDKGQKTAYDFMSSKGEVILQQYIEKVNDLYKDGKGSISKTKFENLLCKGEDIPSDFVERMKKDSQYIAKEAVKMLKTVCPNVYTTTGQVTDFLREEWKLKNLLQELTFEKYKAIGQVKEKIIKTNNGQTKTFKVIADWSKRDDHRHHAIDALICALTDQKIIFKLNNLNKIYQYERNALSQKEIEEIEEFLEGKFSIKEFSAQQGNIIECSIPNIRKDAQKHLENILISFKKENSKVLTMNRNQPKNCKEQITWVPRARLHEDTIMGRVKRIPEKKMKLNDKVSFEQIKMIVNPEIKEILLYRLAKFGDNPKVAFATKALKKEPIFYRENELKEVSIYEWVNTKRVALNENITDSQIEKIIDQASKRAVKERLNGGKIKEVFKNLTENPIQLKNGMILKNVTVTDESKVEKIRNGFAITGKNHHALVYKDENGKYNDKVVSFWEAVAIGLRNVTEYGNPYPIINRNHNDELGEFYFSMQINDLFVFDLKHSENPQEENEINFFDVENRKQISDKLFRVQKMSKKSNGQFVSDFRHHLETSVIRNDMILKNITWISISKNSDLERLTKIRVNHLGEIIKVGE

SEQ ID NO: 763 - protein, 1194 aa, Artificial Sequence
  Cas9
MDFTADVSELNESFMQIHTESKFEIDTAKVQEISQLLLDNKITRMDRQKQVANVLAKNSGDKEADKINKKIATEFCKAVLGNKAKFNVILGEDAVDSDWSFKMDDENSDEEIEILMGQTNGQQQNVLRIIHQWYSQITLNGIVPDGQMISESMIDKYELHRKHLLLLKQQIKVTKDKKKAQQLHEAYEQYVHGTGAKKKLTQDDFYSKVTKNLETSDFSDEIKKQINAETFMPKQRTSANGVIPHQLHQQELDKIIEKQAKYYPFLAELNPDTKRQNIAKYKLDELIAFKIPYYVGPLITTEDQKKTSGKSFAWMVRKEPGKITPWNFDQKVDKMASADQFIRRMTTKDSYLITEDVLPAESLIYQKYKVLNELNMIRVNGNKLTKHDKQNIYQQVFEKYKTVNVKKVQNYFLTDGRYQHAPKITGLSDDNKFNSNLSTYIDFKKIFQDVVDDPQKQKDFERIIEWSTIFEDRHIYEVKLKEISWLNDEQRKELKKKRHQGWGRLSAKLLTGIFDENGYSIMDQLWNTQKNFMQIQAEEGFNKKIQAENSKHLEKNDFEDILEDAYTSPQNKKAIRQVIKVVEDIQKTMGTAPQKISIEFTRSADKNPRRSIERQRQLEEIYYNDAKEIVSEGMQDNLQNFTDNKQTLTDKYFLYFTQLGIDMYTGKKINIDEIGNYQIDHILPQAFIKDDSIDNKVLVSSAINNGKSDNVPLSMYASVRIKSEVQNKWKNFAEHGLISQRKLNNLMTDPESIDKYKARGFIKRQLVETSQVIRLVAEILNEKYQGETEIIEVRAKMNSQLRKDFDLLKNRNVNDYHHALDAYLTTFIGNYLYRRYPKLRSYFTYGHFKKIDDAKLKQFNFLHDIENDKDPKYVNDNGELLWDREKDIAYFKKIYNFKYMLVSHEVSTRQGAMFKQTIFPAAADAKSKLIPIKNDKPTAIYGGYTNNNDAYLAIIKLAKTGQFKVVGVPQRAIVKLKQAYDKETGDYSNVLYKVLEPKFVKKKVNRKTGEITYQVEKFKIVVPKVPYRQLVIDGDQKFMLGSSTYKYNAKQLVLSENAIKILDKKSFDQSGYKSSDLDTVYDEILSQVDRYFSMYDKNKFREGLHNGKKYFQRLPMIDNVEKGKIKENGKFKLLNEILIGLHANPSFGNLKSLGISTPFGMMQFASGISLSENAILCYQSPTGIFERRVALKDL

SEQ ID NO: 764 - protein, 1195 aa, Artificial Sequence
  Cas9
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 765 - protein, 1197 aa, Artificial Sequence
  Cas9
MSKHVLGLDLGVGSIGWCLIALDEQDQPAEILGMGSRIVPLTTDDLNEFSQGKAISKNQKRTTQRTIRKGLDRYQLRRKVLSEKLAGHGMLPDKDLMQLPVLDLWELRARAASPGEKLSLPEIGRVLYHINQKRGYKHAKSDEAEEVTKRGKEQGYVATVKGRYAELQREGATVGQHFACKLKEHRQESPSGGFFYNYRIKDQVYPREAYIEEFDRIMEVQSVFYPEVLTPAFIQELRDKVIFFQRPLKSCKGLVSFCEFEKQERVVQLKRVNREGKEELQERKITIGPKVAPKSSPIAQLCKLWESIHNIRIYYPDGKERPITLEEKRKLLAYLQTHDKLTFTALKKELKISDKERLWCDKLLKGGIKGDTTRVLLRKALAGYKRYEPLLRMDLELRDFQEIVSGKRLIRPIVDESYLSQPLYRLWHILYSIEEREAMRRALIDQLGFLEEDLDGGLLDKLYQIDFAKQGYSNKSAKFICKLLPHLQGGHGYSQACELAGKRHSAGSLTKEELEERPLLEHIPLLQCNELRQPIVEKILNQMINLVNALRQKYGSIDEVRVELARELKMSREEREETSKRIRSREKENKEIAERIKEYELYPTKSRIQKYRLWQEAGEQCLYCGRSIDVVQFLRGDGVEIEHIIPKSILYDDSSANKTCACSRCNKDKGNRTAYEYILAEGREAEYLDRLETLFHDGKLSYSKRRRLQWKKADIPVDFIERQLRLTQYIARQAQEILRQGIRRVGASEGSVTAKLRHLWGYDDILRELNFERYQSMGETEIVSQEEKDGSITKSERIKDWSKRKDHRHHAIDALVVACTRQGYIQRLNSLNSEEDSLQMQEDSKQMREKMGGQKRPTADKHSILENWLILQPHFSHQEVKSKVAEILVSFRPGKRTVSTGRNTYLRSGKKVTQSGVLIPRGPLSEESLYGQILRNGEPTYVKKVALESLSEAQIEQIVDPKLRREMVARTQPSEGAKLNPKLLLATPFYSDAAGTQRVRSVRVAIENGKNSIVPLRYNESGKAITFVNPGNNHHVGIYRTSEGKLVESCVTFWQAVDRVRYGIPTIIRKPREVLDQLLLRDDIPEALLAHLPASDWEFVEYLQANEMFLIGLTDEEIQTALAESDLLTLSNHLYRVQKMSSEYYVFRYHLETEVADNKNNTGIIPKFYRLRGPNDTYLKANPRKVKVNLLGEISLP

SEQ ID NO: 766 - protein, 1204 aa, Artificial Sequence
  Cas9
MERILGIDTGTNSLGWAIVDKDENQYHLVAKGTNIFSEGVKIEKGIESSKAAERTEHRSVRKHYWRRKIRKIRLLTILSDNDLCPRLKHEQLRQWRLKKVYPTDDTFMEWQRTEDKAQVNPYKFRYICLTQKLDLSDITQRFILGRALYHLNQRRGFLSNRKEATKESEGTVKEGISSLSKDMKDSGCEYLGEYFYQLYQQGKKIRNHYTARKEHYLKEFKAICSKQELDDALIEKLEKAIFDQRPLKSQKGQVGTCTFEKGKSRCPSSHPLYEDFRMYSFINNIKVQVDTLYDKGERSLTDEEKQLIIPLFKRKSKRTFPFEDIAKKIAGKNNYCYIKSNEEKAYKFNYQMDTQVSGSPVNAQLEEIFGEDWLSSVCEVYTLANNKSRFQIMNDVWHVLFFYDDEDKLKEFAKDRLQLDDELAEKFSKISIPNDYAALSLKAIRKIMPYLRDYGLIYSEAVFLANLVDVLPQHVWGIKEMREAAIENVIDVMHSYDKNNIDGITLEGCVKTFLKERYQVSDDNLKKLYHPSMLDPYPRQRPNDEGVFQLGSPRISSVKNPMAMHSLFRLRKVVNLMLKKGYITPDTKVHIEFSRDLNDANKRWAIQTWQRENEKERERCRKEIEKYIASPSDTDILKYQLWEEQNHKCLYTGDEIRITDFLGDNPKYDIEHTIPRSAGGDSTKMNLTLCSSRFNRDEKKTKLPAELVNHDEILERISNWKEKYEDIDKQIRKISTKGATSKEDKDSKIRRRHYLILQRDYWRGKYQRFTMTEVPEGFSRRQGTDISVISRYARMYLKSVFKQVYIVKGIATSDFRKMWGIQDEYAKKERVNHVHHCIDAITIACIGKAEYDKLADYRHQYDDYLFQGKTKPTFDKPWPSFVIDIKHIQDELLIAHYAKDNLEKFTKKNLRGKDGRIIRDKFGNKLQMKGDTSRNSLHNDKFYGAINHEGEIKYVYRTNIEALDAKSIGNIVDPTVRSIIESAIAIHGSLKAAINKGIWMNEEKHIPIKKVRVFRNDVKKPIELKDQRDLSDKDYKQHYYVTNDGNYMMLIFSKLNNKGREIRQHVVINSLEATEVIKSHKRSQVGKVVWESYYSKEGFDLIYKLKSGTMILLYENNRDEVWDLDIRNLQKRLYIITKMKYDGRIYMMHHQEAREKKDLEEKSGSFKINEDYRPLIVNSYNQFNALVQDLDFEINDLGEIRRLI

SEQ ID NO: 767 - protein, 1209 aa, Artificial Sequence
  Cas9
MKKDYILGLDIGISSVGWGLLELDDNNNPYKIIDVGSRIFTPGEVEKTGDSRAKERREKRGARRIARRREFRLDRVKNLLYENGYLKGNINSNIVSEKNEELSIIFNNMINNYYNGKNTNPYILKVEALDRKLTDEELSIILVHYAKKRGYKSNREEASDKESGKVLTAIKENEKIMKDNNYRTISEMYIKDDKFKNKIKNSPNDYKISVTNEMYLEEINKVLDSQIKFGLITDDFKNQYLEIYNSRRSYAKGPGGNSPYGGDLIERMTGKCNFDGNPRAPKRAFSSEIYVALTKLVNLKYKVNDGEYIKLSEKEIKNIIEKAKEKKSISYKDLTKMIGNNIDFKDLTLSKKEYIKLIEELKKKLNIKKDTKININELSSEDKELYNKLCNDKLLSKTLIELKGYHILKDSVIKAYSKDIWDEVKDNMYLLDDLALYCTNYKVNEDILNKIKESENIDNIFNDIHFVELLPNFKDHLMLSTELIRKLIPIMYGGNTYDKAMNILGYNHSDINGDKEKKDLLVPICVDDNITNQRVIRSLTQTRKVINSIIKKYGMPKIINIETARELAKSRQERNEIAKNNVEKQAENEKIKNQLVELGLFVSTDKISSTDLLKYKLWKEQNEFCGYSMKKISIEDLFGNNIVQIDHILPYSRTYNDNYLNKTLVYTKENQEKGNRTPYEWFGKTDKWDEYETYINNLTISQKKKDNYLLKKLDFDTEREMRSQNLNDTKYISKELSSLIKAYLNVEKVNMYPGAITAKLRARWGFNRLTHSYLSKNYILPKNIKEDINKDRDNHLHHAMDALVIASITPSLQQKITLYEKFSRYIDGLTELQIKNISYIKIEDSEGQYYNDDTDEVETIDIREYIKQQLAENNIYYNRHNISKLEFPLPYENFDKEAKLRVYEQDLDTLKWNLKSYNTYTQKDIDNVHTLIPSIAKTKVSGKMHEETYYGIKEIGKDEDKKIYKTLRTPIEKVKRKDLDNIPDRLGGSKDVYESLVEWFGDYEVGEEVLKANGNKYPVSKSDKEHKEIKKLKLYSEYKNTGHMINKSNVEKGGIYRIDVFKSKDKEDDKLYFAAYDILEIKKINTLKEKNRVDDNFNIKLDYGQGKNSKIMSYTDIINNYDLYISLNKNDLIKITTNDGKESVAYVVGCSSGMLEVKSKLGDGYDIIKTDLNENNIFSKQRAQYQITVSTIKEIKKLSISVLGEISGL

SEQ ID NO: 768 - protein, 1210 aa, Artificial Sequence
  Cas9
MRTILGLDLGTNSIGWAVINSVIKEQTERIWIEMAGSRIIPMDAAILGDFDKGNSISQTAERTRFRGVRRLRERQLLRRERLHKVLKILGFLPEHYLKGIDFEKHTGKFLSGSEPKLPWVKDRWGKYSFLFQTAFNEMLADFAKHQPSLVFDGKKIPYDWTVYYLRKKALTEMISKEELAWILLNFNQKRGYYQLRGEEEEDNAGKSVEFYALKVLSVEATDEKKGRDIWYNVHLENGWVYRRSSNVPLDWEGRVKEFIVTTDLNPDGTPKLDKYGEVKRSFRAPKEDDWMLIKKRTEADITGTHKTIGSYIYDALLQEPQQKIIGKLVKTVERKFYKEELNFILQKQCAFHAELQDRDLYMRCIEALYPGNEVQRRNIANRDFIYLLIDDVLFYQRPLKTKKSLIANCPYEENEYVNRKTGEIKTAPLKCIAKSHPLFQEFRLWYFLSNIRVYQKEREVNGTLHLDVDVTTEFLKTEDDYVALFDWLNSRKEIDQKAFLRYPAFGLKKEINNYRWNYVEDKFYPCNETRHAILSRLEKAGIGIDFLSDEKETALWHILYSVSDKQEIEKALATFAVKNGLNESFVEVFKKFPPFKSEYGAYSAKAIKKLLPLMRCGKYWDMSLIDGTTKERIERIIAGECDESIGAKVREKAMNLSDISCFKRLPLWLACYVVYNRHSEDKEITKWETPADIDAYLAAFKQHSLRNPIVEQVITETLRVVRDIWKQVGKIDEIRIELGREMKNPADKRKRMTTQILENENANLRIKALLAEFVNPEYGVENVRPYSPSQQEILRIYEDAVLKGEEQIPEDIDVILKKFNTSKLPTKSEFLRYKLWLEQKYRSPYTGELIPLAKLFTAAYEIEHVIPQSRYFDDSFSNKVICESAVNKLKDNQLGYEFIKNHHGQKVEVGFGKTVEIFSVDSYERFVKEQYAKSGIKMKKLLMDDIPEQFIERQLNDSRYISKVVKGLLSNIVREKNDSGEYEPEAVSKNILVCTGSVTDRLKKDWGMNDVWNSIVSPRFERLNALTETQCFGHWENKDGKKVFQTAVPLEYQKGFSKKRIDHRHHAMDAIVIACATRNHVNYLNNESASRNAKISRYDLQRLLCDKSRGDGNGNYRWIIKKPWTTFTQDAREALSGIIVSLKQNLRIINKTTNIYQHFDANGTRVYEKQKIGDSWAIRKPMHKDTVFGAVNLRKALIPQHYNLTLFISS

SEQ ID NO: 769 - protein, 1213 aa, Artificial Sequence
  Cas9
MEKRLGIDVGTNSLGWAIVEVDDEGCTLLDRGVDIFQEGVAREKNQEKPAVQDRTDARALRRHYFRRRLRKIALLRVLVRHDLCPALSEEQLNAWQGKGIYPLDDAFIRWQRTDDNADRNPYRDRFRCLTEELDLACREERYVLGRALYHLCQRRGFLSNRKDAGNEAEEGKVKQEIKTLSADMAAAGCEYLGEYFYRLYQRKEKIRKHYTARNEHYLAEFRAICRKQRLDEELRQALEKAIFYQRPLKSQKGLVGKCTFEKDKSRCPVSHPRFEEFRMLQFINNVRVTGPGDAEPRPLSPEEVEIVRPLFLRKSKPHFDFEDIAKKIAGKGNYACRGELLQAPYRFNCAGKSTVTGSPVSALFASVFGDDWQREICSLYTLGAGKNEEQILNDVWHVLFAFEDEERLQAWLQEKLQLSADDAKTLAAFRLPQGYASLSLNVINKILPYLRRGYRYDEAVFFANLGKVLPAEVYADPARRREVEQGISAQMDDLGDGEKTRKEERIRDYLRRYWGVEEKRLERLYHPSMIEAYPSASPNGQGLLQLGSPRIPAVRNPMAMRALFRLRVLLNELLREGKIDRGTKINIELARELNDANKRKAIERYQREREAENRKYAEEIRQQYVEATGHSIEPSEEDILKYRLWVEQGHCSLYTGKTIGISEFLGDGRRYDIEHTVPRSRGGEDAQYNKTLCEEEFNRDIKRDKLPSELANHTAILACVESCGWFERIEGLEHRVWGADRRAKSATTKSAKDFAIQDRHYWRMHLDYWRRKCEAFTMTEVPEGFSNRQGVDVGIIGRYARLYLQTVFDRVYTVKGATTAAFRRMWGLQEEYAAKERVNHVHHCIDAITIACIGSREYALWAQYVRQDELYRWGEADKPRCGKPWPTFTEDVRATADELLISHHTPDNMPKQSRKRLRVRGKVQRNDRGEVKYMQGDTARGALHQQTFYGAIERDGEIRYVVRKSLDQLLPADVEKIVDEAVRQKVREAVEAYGFKEATDPTKHTVWMNEEKQIPIRKVRILTGVKNPILLKPHRDVSVKEYKRYYHVVNDGNYCMAIYEGRDRQGRLKRTFEIVNKLEAARYFKRSADRESRPDLVPLSDVNGYSLKYLLKTGTMVLFYENSPDELYECSVGELAKRLYKVVGMAQDGRVQFLFHQEARDQKAVTAECGMGISVFDARHPAPKLRIRVSNFKMFVEGYDFELTVTGEVKFKR

SEQ ID NO: 770 - protein, 1213 aa, Artificial Sequence
  Cas9
MEKRLGIDVGTNSLGWAIVEVDDEGCTLLDRGVDIFQEGVAREKNQEKPAVQDRTDARALRRHYFRRRLRKIALLRVLVRHDLCPALSEEQLNAWQGKGIYPLDDAFIRWQRTDDNADRNPYRDRFRCLTEELDLACREERYVLGRALYHLCQRRGFLSNRKDAGNEAEEGKVKQEIKTLSADMAAAGCEYLGEYFYRLYQRKEKIRKHYTARNEHYLAEFRAICRKQRLDEELRQALEKAIFYQRPLKSQKGLVGKCTFEKDKSRCPVSHPRFEEFRMLQFINNVRVTGPGDAEPRPLSPEEVEIVRPLFLRKSKLHFDFEDIAKKIAGKGNYACRGELLQAPYRFNCAGKSTVTGSPVSALFASVFGDDWQREICSLYTLGAGKNEEQILNDVWHVLFAFEDEERLQTWLQEKLQLSADDAKTLAAFRLPQGYASLSLNVINKILPYLRRGYRYDEAVFFANLGKVLPAEVYADPARRREVEQGISAQMDDLGDGEQTRKEERIRDYLRRYWGVEEKRLERLYHPSMIEAYPSASPNGQGLLQLGSPRIPAVRNPMAMRALFRLRVLLNELLREGKIDRGTKINIELARELNDANKRKAIERYQREREAENRKYAEEIRQQYVEATGHSIEPSEEDILKYRLWVEQGHCSLYTGKTIGISEFLGDGRRYDIEHTVPRSRGGEDAQYNKTLCEEEFNRDIKRDKLPSELANHTAILACVESCGWFERIEGLEHRVWGADRRAKSATTKSAKDFAIQDRHYWRMHLDYWRRKCEAFTMTEVPEGFSNRQGVDVGIIGRYARLYLQTVFDRVYTVKGATTAAFRRMWGLQEEYAAKERVNHVHHCIDAITIACIGSREYALWAQYVRQDELYRRGEADKPRCGKPWPTFTEDVRATADELLISHHTPDNMPKQSRKRLRVRGKVQRNDRGEVKYMQGDTARGALHQQTFYGAIERDGEIRYVVRKSLDQLLPADVEKIVDEAVRQKVREAVEAYGFKEATDPTKHTVWMNEEKQIPIRKVRILTGVKNPILLKPHRDVSVKEYKRYYHVVNDGNYCMAIYEGRDRQGRLKRTFEIVNKLEAARYFKRSADRESRPDLVPLSDVNGYSLKYLLKTGTMVLFYENSPDELYECSVGELAKRLYKVVGMAQDGRVQFLFHQEARDQKAVTAECGMGISVFDARHPAPKLRIRVSNFKMFVEGYDFELTVTGEVKFKR

SEQ ID NO: 771 - protein, 1216 aa, Artificial Sequence
  Cas9
MTKILGIDTGTNSLGWAIVDKTADNYNLLDKGVNIFQEGVKIEKGIESSKAAERTEHRATRVRYYRIKLRKIRLLRILSDNHLCPPLSQEELSTWRLKKVYPKNELFMQWQRTDDDTEKTPYAYRHKCIHEKLDLSDVTDRYILGRAFYHIIQRRGFLSNRKEQGGEDSGKVKEGISTLTHEMNEAGYEYLGDYFYALYNKGEKIRKHYTARNEHFLSEFKAICEKQDLEKELGSEVVRNIEKAIFDQRPLKSQKGQVGKCVFEKNKTKCPSSHPMYEEFRMLTFINNIKIKTPNDDVLRPLNTGEREKIMPLFFRKSKKQFDFEDITKKLAPKKMYGFYKKEEDAEMPFLFNYPMDTSVSGCPVTAALKDVFGDDWITAICETYTLGEGKSRFDIVNDIWHALYFYSDKDKLAEFAINRLQLSEDEAKIFSEISLPADYASLSLKAICKILPYLRRGLIYSHAVFLGNLCEVMPKYEWSIKEMRETIIDNIIMEMDKCDTKDKRTFEVCIKDYLKGQYNVSDNSLKKLYHPSMIETYPRVQYTNEHGVYQLGSPRIDSVRNPMAMRSMFRLRKLVNRLLVEGKIDQNTEVHIEFARELNDANKRNAIALFVKENQSANDEARKQIITLFKKETGTDIEPTDKDILKYVLWEEQNHICLYTGKQIRISDFIGANPKFDIEHTIPRSVGGDSTKMNLTLCDSRFNREVKKTKLPVELPNHDEIMERIKEWKKNYELLDIQIRKNKKLSKGATTKEQKDTIIRKRHLLELRRDYWRGKYERFTMESVPEGFSRRQGTDISVISKYARLYLKSLFNRVYTVKGIATSDFRKIWGIQDIYSKKERINHVHHCIDAIVIACIGLDEYNKLGAYYHDEENNKWYGMSKASFKKPWATFVEDIKKIQDEILVYHYTPDNMPKQGRRRIKIDGKKILCKGDAARGSLHNDTYYGAIENDGAVKYVKRIDLASLEEKDVKNIVDDTVRSIIEAAIKEKGFKDAMASTIWMNEEKRVPIKKVRCFTPSITKPLNIRKQRDVSIKEYKQQYHVANDSNYLLALYIGTDNKGKEKREFEIVNILQAAQYYRTSNDKEVVDRHIVPIKSEHDYPFAYTLKIGTMVLLYEKSPNEVWDATIKERNRRLYKVTGLSTMRMKGRNGEYAYATVKLIHNEEARPSKDIKAKNGEYEQGEEFRPAIIMLHTQLNALVQGYDFEINELGEIRRLR

SEQ ID NO: 772 - protein, 1217 aa, Artificial Sequence
  Cas9
MEKQRILGLDPGTNSLGWAVLDFDNSKQEYNLVRKGEVIFEEGVGKSERGEFSKAAYRTFYKSTRKHYFRRRLRKIEVLKVLVKYDFCPYLSDDLLKQWHEKKIYPAVKEFMDWQRTSDAEGKNPYYDRHCCLNEKLDLSLKSDRYILGRALYHLTQRRGFKSNRLIQNNDENEEGKVKKGISELSTEMQEANCNYLGDYFYKLYTEKGNTVQIRKRYTDREKHYKNEFNAICEKQELNETIVKELDKAIFFQRKLKPQRHGVGKCTFEPNNRRCAISHPDFERFRMLCFINNIKIKTPFEENLRPLNNEEKALIEPLFYRKSIKNFDFEEIAKKLAGKNNYCYIKDDSSKQYKFNYRMSQGASTCQTIAKLKSIFGEEWKNGIAETYTNRRKKEGLKKQAEMVDDIWNVLYSVSECDVLKDFAINKLQLDEKTADNFSKTKLAQGFATLSLKAIRKILPFLEQGFGYTEAVFLANIPTVVGKEYWNNEDIRNDIMEEIKTIFYHNTLKTNDSHNTILFCIKDILSNNFDLAPGAIDKLYHPSMINVYKDVIPNEDGILQLGSPKIDAVKNPMAMRSLHIIRKVVNELLREGIINSDTEVRIEYARELNDANKRHAIADWQKKQYGKHQKYRKEIKELFKAETGFEIEPNETDILKFELWEEQNHICLYTGQEIGISEFVGENPKYDIEHTFPRSLGGDSTKMNMTLCENKFNRENKQKKLPSELANHSEILERIDDWKKKIYILQKKYDSIRTHNGMDKENKDKKIVSRHKIKLELDYWKGKYNRFTMTEIPEGFSRRQGMGIGLISRYAGLYLKTIFHKKDNPQKSNVYIVKGSITAEFRRIWNIQDDYEKKCRDNHIHHCIDAIVVGCIGKREYDLMAQFYRDEEKYRWEKKKKPFFKKPWETFTQDMLSLKDEVLTVHFNPSNFTKKAHKKVFTPKGIFVAQGDCARVKLHKGSYFGAIEQKGEIKYVMRKELSALKIEDIKNIVDAVVKEKVLAVVKKKGFKQAMAEPIYMNEDKRILIKKVRLFVSQANPLIVKKHRDLSSKEYKQNYYVDNEGNLMIAMYEGVKKNGKIDREITVVNNLEAAKFFRQSQKNNAEKQLISHLSPKNGYPLKTVLTQKQLVLMYEDSPKEIKLRDTKNMVKRLYQVFGIEKDGRVKLKFHQEARSEGLNINSAAFKIQDTPESLYRHTKSNLKVLVNGVDFKINILGEISLI

SEQ ID NO: 773 - protein, 1217 aa, Artificial Sequence
  Cas9
MEKQRILGLDPGTNSLGWAVLDFDNSKQEYNLVRKGEVIFEEGVGKSERGEFSKAAYRTFYKSTRKHYFRRRLRKIEVLKVLVKYDFCPYLSDDLLKQWHEKKIYPAVKEFMDWQRTSDAEGKNPYYDRHCCLNEKLDLSLKSDRYVLGRALYHLTQRRGFKSNRLIQNNDENEEGKVKKGISELSTEMQEANCNYLGDYFYKLYTEKGNTVQIRKRYTDREKHYKNEFNAICEKQELNETIVKELDKAIFFQRKLKPQRHGVGKCTFEPNNRRCAISHPDFERFRMLCFINNIKIKTPFEENLRPLNNEEKALIEPLFYRKSIKNFDFEEIAKKLAGKNNYCYIKDDSSKQYKFNYRMSQGASTCQTIAKLKSIFGEEWKNGIAETYTNRRKKEGLKNQAEMVDDIWNVLYSVSECDVLKDFAINKLQLDEKTADNFSKTKLAQGFATLSLKAIRKILPFLEQGFGYTEAVFLANIPTVVGKEYWNNEDIRNDIMEEIKTIFYHNTLKTNDSHNTILFCIKDILSNNFDLAPGAIDKLYHPSMINVYKDVIPNEDGILQLGSPKIDAVKNPMAMRSLHIIRKVVNELLREGIINSDTEVRIEYARELNDANKRHAIADWQKKQYGKHQKYRKEIKELFKAETGFEIEPNETDILKFELWEEQNHICLYTGQEIGISEFVGENPKYDIEHTIPRSLGGDSTKMNMTLCENKFNRENKQKKLPSELANHSEILERIDDWKKKIYILQKKYDSIRTHNGMDKENKDKKIVSRHKIKLELDYWKGKYNRFTMTEIPEGFSRRQGMGIGLISRYAGLYLKTIFHKKDNPQKSNVYIVKGSITAEFRRIWNIQDDYEKKCRDNHIHHCIDAIVVGCIGKREYDLMAQFYRDEEKYRWEKKKKPFFKKPWETFTQDMLSLKDEVLTVHFNPSNFTKKAHKKVFTPKGIFVAQGDCARVKLHKGSYFGAIEQKGEIKYVMRKKLSALKIEDIEHIVDAVVKEKVLAVVKKKGFKQAMAEPIYMNEDKRILIKKVRLFVSQTNPLIVKKHRDLSSKEYKQNYYVDNEGNLMIAMYEGVKKNGKIDREITVVNNLEAAKFFRQSQKNNAEKQLISHLSPKNGYPLKTVLTQKQLVLMYEDSPKEIKLRDTKNMVKRLYQVFGIEKDGRVELKFHQEARSEGLNKNSAAFKIQDTPESLYRHTKSNLKVLVNGVDFKINILGEISLI

SEQ ID NO: 774 - protein, 1217 aa, Artificial Sequence
  Cas9
MKYNYVLGLDIGISSVGWGLLALDENNNPYKIIDVGSRIFSPGEVEKTGDSKAKERREKRGTRRVIRRREFRLDRVRNLLYEKGYLKGNITSNIVSVKNEELTIIFNDMVNNYYKSKDTNPYKLKVEALDRKLTNDELSIILVHYAKKRGYKSNREESSDNDNGKVKEAIKENTNLMEEKKYRTISEMYIKNEKFKNKIKNGPDDYKLSVTNEMYLEEINKVLDSQIGFGLIDDNFKNEYLEIYNSRRHYSEGPGYYYAKDANGNKVKVRSPYGGDLIKKMTGVCSFDKKARAPKYAFSSELFVSISKLVNLRYKIDDDSYKQLTKEQINELIDEAKNKNKVTYKSLIKILGIKNIKVKDLNLSKSEYIKVIDELKKKLNISKEEKIDIYSLDEENKKIYDDIYNEKLFSKTLIEFKGYNLLKKAITLSYNSGTWNDVKDNIEFLDELALYCTDYKVNNEIQEHIHNSLIIDSRFDDSNFVENLPNFKDHLMLSTDIIRKLIPIMLEGITYDKAMDKIGYNHSNLYKDTIKEDLLVPVYVSKNITNQRVIRSLTQARKVINAIIKKYGSPKIINIETARELAKTQKERRIIEKNQQDKQYENERIKKHLVELELFSDESKITGNDLLKYKLWQEQKEFCGYSMKKIKLEDLFSNNIVQIDHILPYSRTYNDNYLNKTLVYTKYNQDKGNKTPYEWFGKTDKWQEYEAFINSLSISQNKKDNYLLKNLDQDAEREMREQNLNDTKYISRELLSLIKAYLNVDEVNAFPGAITAKLRARWGFNRLTHSYISKTYIMPEDMKKGINKDRDNHLHHAMDALVIASITKSLQQKITLYEKFSRYVDGITKNELGKISTGNINDDLYNYYDEETGEIKELELRQYIKNQVAQNNIYFSKHNVSKLIFPTPYNNFVEEAKLRVYERDLEVLKWNLKNLGTYTSSELNRIHVLIPSVAKNKISGRLHEETYYGLKEVGIGEDKVTYKTLKTPISKVKKKDLDNIPDCKGGSKDIYNALVKWFGNCETGEEALKMHDGKYPVNPNDKEQKEIRKIKVYTKYNATGHVVNNGNVEKGGIYRIDVFKSKNKEDNKLYFTSYDIFEIEQIKAYEKGKNINFSIKLEYGQGKNNKILLYKDVKNEYDLIMSIYKNDLIRIKTKTGNKSTAYVVGFSGGKLEIKSTIGDGYDIIGNNNIFDKSMERYRVTSSTIVKIDKLSISILGEVSGL

SEQ ID NO: 775 - protein, 1218 aa, Artificial Sequence
  Cas9
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYHEQGNKVRIRQRYTDRKKHYQHEFDAICEKQELSSELIEDLQRAIFFQLPLKSQRHGVGRCTFERGKPRCADSHPDYEEFRMLCFVNNIQVKGPHDLELRPLTYEEREKIEHLFFRKSKPNFDFEDIAKELAGKKNYAWIHDKEERAYKFNYRMTQGVPGCPTTAQLKSIFGDDWKTGIAETYTLIQKKNGSKSLQEMVDDVWNVLYSFSSVEKLKEFAHHKLQLDEENAEKFAKIKLSHSFAALSLKAIRKFLPFLRKGMYYTHASFFANIPTIVGKEIWNNEQSRKYIMENVGELVFNYQPKHRDVQGTIEMLIKDFLANNFELPAGATDKLYHPSMIETYPHALRNEFGILQLGSPRTNAIRNPMAMRSLHVLRRVVNQLLKESIIDENTEVHVEYARELNDANKRRAIADRQKEQDKQHKKYGDEIRKLYKEETGKDIEPTQTDVLKFQLWEEQNHYCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYHMEETFRQGRGSKPKFSKPWATFTEDVLNIYKNLLVVHDTPNNMPKHTKKYVQTSKGKVLAQGDTARGSLHLDTYYGAIERDGEIRYVVRRPLSSFTNPKELENIVDETVKRTIKEAIADKNFKQAIAEPIYMNEDKGILIKKVRCFANSVKQPINIRQHRDLSKKEYKQQYHVMNENNYLLAIYEGLVKNKVVREFEIVSYIEAAKYYKRSQDRNIFSSIVPTHSTKYGLPLKTKLLMGQQVLMFEENPDEIQVDNTKDLVKRLYKVVGIEKDGRIKFKHHQEARKEGLTIYSTPYKNNDDYVPIFRQSIKNINILVDGIDFNIDILGKVTLKE

SEQ ID NO: 776 - protein, 1218 aa, Artificial Sequence
  Cas9
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 777 - protein, 1218 aa, Artificial Sequence
  Cas9
MNKRILGLDTGTNSLGWAVVDWDEHAQSYEFIKYGDVIFQEGVKIEKGIESSKAAERSGYKAIRKQYFRRRLRKIQVLKVLVKYHLCPYLSDDDLRQWHLQKQYPKSDELMLWQRTSDKKGKNPYYDRHRCLHEKLDLTVEADRYTLGRALYHLTQRRGFLSNRLDTSADNKEDGVVKSGISQLSTEMEEAGCEYLGDYFYKLYDEQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTTAQLKSIFGDDWKTGIAETYTLIQKKNGSKSLQEMEDDVWNVLYSFSSVEKLKEFAHHKLQLDEESAEKFAKIKLSHSFAALSLKAIRKFLPFLRKGMYYTHASFFANIPTIVGKEIWNNEQNRKYIMENVGELVFNYQPKHREVQGTIEMLIKDFLANNFELPAGATDKLYHPSMIETYPHAQRNEFGILQLGSPRTNAIRNPMAMRSLHILRRVVNQLLKESIIDENTEVHVEYARELNDANKRRAIAGWQKEQDKQHKKYVDEIRKLYKEETGKDIEPTQTDVLKFQLWEEQDHHCLYTGEQIGITDFIGSNPKFDIEHTIPQSVGGDSTQMNLTLCDNRFNREIKKAKLPAQLSNHEEILARIEPWKNKYEQKIKERDKQRTFAGMDKAVKDLRIQKRHKLQMDIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFRQGRGSKPKFSKPWATFTEDVLNIYKNLLVVHDTPNNMPKHTKKYVQTSKGKVLAQGDTARGSLHLDTYYGAIERDGEIRYVVRRPLSSFTKPKELENIVDETVKRTIKEAIADKNFKQAIAEPIYMNEDKGILIKKVRCFAKSVKQPINIRQHRDLSKKEYKQQYHVVNENNYMLVIYEGLVKNKVVREFEIVSYIEAAKYYKRSQDRNIFSSIVPTHSAKYGLPLKTKLLMGQLVLMFEENPDEIQVDNTKDLVKRLYKVVGIKKDGRVKFKFHQEARKDGLLIFSTPYKNNNGYVPIFRHSKKNINILVDGKDFTIDILGKVTLKE

SEQ ID NO: 778 - protein, 1219 aa, Artificial Sequence
  Cas9
MKEEVRGKNRSQTWAILAKFFVWSEKESVWNEKEARTEERVKEYKLVGLKRDTKGNELKLENYRWRVQALSEQLNPEIVAIVLQEINGQISASSGYLGAISDRSKQLYFNRQTVGQYLMSELEKDPNVSLRNRVFYRQDYLDEFDRIWEKQAEFHEELTVELKKEIRDIIIFYQRRLKSQKGLISFCEFEKREVVVEEDGRKKNKTVGCRVIPRSHPLFQEFKIWQTLNDIEVFAWDKQSKRKKADKSSILFDNSEDALLVEGKRFLYQEEKELLAKELFVKESMKKAEVLKLLFENYQELDLNFKQIDGNHTGFALFSAYSKMIEKYGYEPVDFKRSADEIIEKLETIFTNLGWNTELLSIDLSKEDKELERQSYFRLWHLLYSFEGDNTPTGNGKLLEKIMQLCDVEKEYAVELANVSFQEDYGSLSAKAIKKILPYLKEGNQYDVACDYAGYRHSRSSLTKDEIENKILKDKLEILPKNSLRNPVVEKILNQMVNLINTLIDTYGKPDEIRVELARELKKNAKEREELTKSIARNTREHDEIRQLLRTEFGMMNVSRNDIIRYKLYEELKDNGYKTLYSNEYIPREKIFSKEIDIEHVIPQARLFDDSLSNKTLEYRAINIEKGNKTAYDFVKEKYGNDGLEKFLNRCETLFKDKRTKLRKLKMEEKDIPEGFIDRDLRNTQYISKKAFAMLNEISRRVVATTGSITDKLREDWQLVDLMKELNLPKYEKLGMVEMFEDKDGRKIKKITDWTKRNDHRHHAVDALTVAFTKDVFIQFYNNKNAAWMPASKEHANITGIKARYFENGKALAPMPLAQFRAEAKRHLENLLVSIKAKNKVITSNVNRTKNKNGENRKLQQTPRGQLHLETVYGSHRQYATKIEKVNAAFDVTKIATVSKLAYRNALLKRLEAFGNDPKKAFTGKNTLEKNPLYLDENQTEMVPEKVQTVEFETVYTIRKPIDPNLSIDKVVDVKIRSVLEKRLKEYGGDAKKAFVNLDENPIWLNEAKGISIKRVSIRGISNAQSLHEKKDKDGNLILGKEGRKIPVDFVNTGNNHHVAIYKKPVLDKVGQVVLDEEGNPKYELDEVVVSFFDAVTRANLGQPIIDKDYRRSEGWQFLFSMKQNEYFVFPNDKTGFNPKEVDLLNPENYALISPNLFRVQKFAYKNYVFRHHLETTIKDTSSTLKGITWTDFRSSKGLDKIVKVRVDHIGQIVSIGEY

SEQ ID NO: 779 - protein, 1220 aa, Artificial Sequence
  Cas9
MKRILGLDLGSASIGWALIEEDEKGIRIIALGSRIIPYNGTEGQDFAKGAGESRNSLRTQARTTRKGYDRYQLRRKYLINVLEKNLMMPSEDLRKMPKMNLWQLRSKAVTEYISRQELGRLLLWLNQKRGYKSSRSDANLDKKDTDYVKEVKSRFDKIKEKNQTIGQYFYESLQCDEYFRVKENVFPREAYIAEFDAICSRQKDHLGLSEELIAEIRNEIIYYQRPLKSQKGLVSVYDFEGKWMNQNGKELFIGPKVAHKSSPLFQLAKIWESVNNIKLSTKYGDTIELTLEEKKQLVEFLDNNEKLTTAALFKILRKDKKEYILPKQLEKGLQGNITKCKIADILGSKYNQLLQLNLEKQEVGTPCYLYTKSTGEVLGEKPLQYIDKSVEKELFYQLWHTIYSISDEDECCKALQKRFDIDAETAGRLAKIDFSKYGFGNKSAKAIRKILPYLMEGDKYSDAMCYAGYNHSNSLTKEENHERKLNDKLKLLTKNSLRQPIVEKIMNQMIQLVNTIIDKYGKPDEIRLELARELKQSKEERNDADKAMSKRQRENKEAEKKLEEHGIRATHNNILKYRLFEEMGEKKHEAICIYCGNPISFSAAMNGDEVDVEHIIPRSKLFDDSQSNKTLAHRKCNANKNDMTAYDFMKTKSKQDFDKYVERVNQLYADRIISRSKYNKLLMSEDDIPSNFIDRQLRESQYIATKAREILQTICYNVWSTSGTVTAELRHLWGWDDITMNLQMPKYKELGLTEMVEWTSDHGKNVHSKEVIKGWTKRDDHRHHAIDALTIACTKQGFIQRFNTLSSSKTRDDMQKELEKCSIQFREKRSLLEKYIISQRPISVSDVAEAVSRILISFKAGKKVATIGKRKVKGKVVQQGIVVPRGALSEGSVYGKIRTIVRKMPVKYLFENPDLIFKPYIKALVKERLAEFDNDNKQALASLKKNPVYLDKEKTKLLEYGTCFKDEYVKKYDVNPNFTKIADVIDGKVKQILEDRLSKFGGKPKEAFKDVVKDGKTLKWYEDEGLERPIRSVRCLTGLSAVVPVKKDENGMDIGFVKPGNNHHVAIYVGADGKGQEHVCTFWNAVERKKYGLPIIIKDANEVWDKITMAGDDVYPQSFLSLLPKPDWTLKLSMQQNEMFILGMEEDEVKFAIESKDYKLLSDHLYRVQKLSSSDYNFIHHLETDVQKKTMTYRVRSLSGLFALRPFKVRIDCLGNIIPS

SEQ ID NO: 780 - protein, 1222 aa, Artificial Sequence
  Cas9
MKKRILGLDSGTNSLGWAVVDRDENNQYSLIKYGDLIFEEGVKIEKGVESSKAAERTSHRALRKLYFRRRLRKIEVLKVLVKYNLCPQVSEEELHLWHTRKLYPQNKDLLQWQRTDEKAGKNPYIYRYRCLHEELDMSVSANRMTVGRAMYHLAQRRGFLSNRLDNEEDENQIGAVKCGISNLTEEIQSSGCKYLGEYFYKLYNEHGNTVRLRTRYTSREFHYKKEFYAICEKQKLDKKLIEELASALYFQRPLKSQRHTVGRCTFEPNKPRCADSHPAYEEFRMLSFINTIKVQGPYDTELRVLNTEERDSITKLFCRKSKPNFDFEDIAKELAGRNNYCYIGDVVDKAYKFNYRMSQGVSGCPTTTYLINVFGQDWQTGIAESYQAIDTKLGQKSVDAMIDDVWNVLYSFSSKDKLRDFGRKKLQLGDKEADTFANIKLTHKFASLSLKAIRKINIFLRMGLVYSHAVTLANIPTIVGTDIWQRKRNFILAELLPLIENFNPKETKLQETLDFCVKDFLQNNFELKNGAVDKLYHPSMIEAYPDAGLNSNGILQLGSPRTNAIRNPMAMRSLHEIRKVINQLLKDKIINQDTEIHVEYARELNDANKRKAISIWQKSQEKLHKKYVEEITNLYKEETGKAIVPTDTDILKFKLWEEQNHICLYTGQQIGIAEFLGATPKYDIEHTIPQSVGGDSTDMNLTLCDSRFNREIKKAQLPTQLGNHADILVRIAGWKNSYEKLSKDIDRIRTHSGMAKDIKDRLIQKRHLLKLERDYWRGKYERFTMNEIPEGFSRRQGVGIGLISKYAGLYLKSLFHDKNERNKGHVFVVKGTTTAEFRKMWGLQNEYEKKSRNNHVHHCIDAITIACIGKHEYAQMAQYYHDEAEYLYHHGIKPIFPKPWKTFTEDLLDLEHSLFVVHHSPNNMAKQARKRIITSTGQHWAQGDSAHGSLHNDTYYGAIERDGEIKYVVRRAVSSFEQMSDVDSIVDDVVKETVRKALEGKNFKEAVNAPIYMNKEKGVLIKKVRCYAKSIKKPIDIRTHRDSSSKEYKRKFHVSNDINYLIAIYEGTVKGKVKRDFEVVKNIEAANFFKRSQDRRDYPTIVPEKSIKHGFPLKTTLTNGTMVILYEENKEEIDFTKKEDICRRLYKLVGMSSMIVSGCEYGVLSLRHHQEARPSKDIKSKNGAFKNGEALRPAITMLHTQFNALVENIDFNIDVTGNIELI

SEQ ID NO: 781 - protein, 1222 aa, Artificial Sequence
  Cas9
MKKRILGLDSGTNSLGWAVVDRDENNQYSLIKYGDLIFEEGVKIEKGVESSKAAERTSHRALRKLYFRRRLRKIEVLKVLVKYNLCPQVSEEELHLWHTRKLYPQNKDLLQWQRTDEKEGKNPYIYRYRCLHEELDMSVSANRMTVGRAMYHLAQRRGFLSNRLDNEEDENQIGAVKCGISNLTEEIQSSGCKYLGEYFYKLYNEHGNTVRLRTRYTSREFHYKKEFYAICEKQKLDKKLIEELASALYFQRPLKSQRHTVGRCTFEPNKPRCADSHPAYEEFRMLSFINTIKVQGPYDTELRVLNTEERDSITKLFCRKSKPNFDFEDIAKELAGRNNYCYIGDVVDKAYKFNYRMSQGVSGCPTTTYLINVFGQDWQTGIAESYQAIDTKLGQKSVDAMIDDVWNVLYSFSSKDKLRDFGRKKLQLGDKEADTFANIKLTHKFASLSLKAIRKINIFLRMGLVYSHAVTLANIPTIVGTDIWQRKRNFILAELLPLIENFNPKETKLQETLDFCVKDFLQNNFELKNGAVDKLYHPSMIEAYPDAGLNSNGILQLGSPRTNAIRNPMAMRSLHEIRKVINQLLKDKIINQDTEIHVEYARELNDANKRKAISIWQKSQEKLHKKYVEEITNLYKEETGKAIVPTDTDILKFKLWEEQNHICLYTGQQIGIAEFLGATPKYDIEHTIPQSVGGDSTDMNLTLCDSRFNREIKKAQLPTQLGNHADILVRIAGWKNSYEKLSKDIDRIRTHSGMAKDIKDRLIQKRHLLKLERDYWRGKYERFTMNEIPEGFSRRQGVGIGLISKYAGLYLKSLFHDKNERNKGHVFVVKGTTTAEFRKMWGLQNEYEKKSRNNHVHHCIDAITIACIGKHEYAQMAQYYHDEAEYLYHHGIKPIFPKPWKTFTEDLLDLEHSLFVVHHSPNNMAKQARKRIITSTGQHWAQGDSAHGSLHNDTYYGAIERDGEIKYVVRRAVSSFEQMSDVDSIVDDVVKETVRKALEGKNFKEAVNAPIYMNKEKGVLIKKVRCYAKSIKKPIDIRTHRDSSSKEYKRKFHVSNDINYLIAIYEGTVKGKVKRDFEVVKNIEAANFFKRSQDRRDYPTIVPEKSIKHGFPLKTTLTNGTMVILYEENKEEIDFTKKEDICRRLYKLVGMSSMIVSGCEYGVLSLRHHQEARPSKDIKSKNGAFKNGEALRPAITMLHTQFNALVENIDFNIDVTGNIELI

SEQ ID NO: 782 - protein, 1225 aa, Artificial Sequence
  Cas9
MSKRILGIDVGTNSLGWAVVDRTDCDNYTLVKRGDVIFQEGVNIEKGNIEKSRASERTGHRSTRKHYFRRRMLKIKVLEILVEHQLCPYLSHEELHQWMTRKVYPTNEDFRLWLRTNDANDQNPYHDRHVCLHERLDLRLQENRYRLGRALYHLAQRRGFLSNRLEQNSKTDETGAVKSDISQLNEEMKKAGSQYLGDYFYWLYQEYGNQVTLRIRYTDRKQHYQKEFEAICQRQQLSDDLVDKLRRAIYFQRSLKSQRAGVGKCTFEPDKPRCALSHPRYEEFRMLSFLNNVKVKGPSDDSLRPLSPSEKEKIKPLFLRKSKANFDFEDIAKAIAGKGKYACIRDKEGAQKPYQFNYALSQGVSGCPVTAKLIAVFGESWERNLVNAYRSRNDMRKSDEEIVNEVWNVLYSFSSKEKLRAWGMEKLGLDEACAGEFADITLPTAFAALSLKAVNKILPFLRQGFIYSHAVMLANIPYIIGMDRWNEPRQRQFIMDNLQELLDNFTASDKALQQTLDFCIKDFLLNNYELAPGKADRLYHPSMIETYPDAKADGQGIYQLGSPATNAIRNPMAMRSLHILRRVVNQLLKEKTIDSETEVHIEYARELNDANRRWAINQWQRKQETQRKDYAEKIRKVYADEFEKVIEPTQEELLKYQLWEEQQHLCLYTGEQIGLTDFIGPNPRYDIEHTIPQSMGGDSTRMNLTLCERTYNRTVKGNRMPSQLAEHESILTRIKPWKDKYEELTVKINKLRTHPGMDKASKDNIIRKRHLLELERDYWFQKYQRFTMTEVPEGFSLRQGTGIGLIGKYAGLFLKSLFHHVKERNRKQVYVIKGPITAEFRRLWGLQNLYEQKSRDNHAHHCIDAIVIACINPAEYARMASYYRQEEDFRLNKGNKPVFPKPWTTFTQDLQALEAELLVVHETRNNLTKKARKRVRTKGGNVLSESDSARGSLHNDTYYGAIQKDGVIRYVVRKALSSLSEKDVKDIVDKTVREKVQAAIQEKGAKEALAGTIYMNEEKGITIKKVRCFTKIASPLAIRRHRDASAKEYKRPYYVTNESNYVMGIYEGCIKEKTKREFILVNNLEAVRQLKAARKQGVVSSILPPVSAKSQFPLKYRLYTGTLVLLYENSPEEIDFTNQVDICKRLYKVTGLSSMTVTGNQYGTIQLRYHQEARQAKDLKAQNGAYKEGEEHRPAIMMLHTQFKALVEGTDFRMNILGEIEPLRK

SEQ ID NO: 783 - protein, 1229 aa, Artificial Sequence
  Cas9
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEKDRKFDIREIYLAVHHIIKYRGNFLNGTPMRSFKVENIELNTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKGIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQSRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRHLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLRPYFVYDNFKKFGNKEDIGHKRFNFLGKIEREKKVVAPETGEILWSNVAPNETIKQIKKVYNYKFMIVSREITTRRAELFNQTVYPKNYRGKLIPIKEDRPTDLYGGYSGNTDAYLAIVALEDKKKGKYFKVVGIPTRAAAKLEKLKQQDSQQYLQALHEVIAPQFTKSTKKGIKKTEFEIVLDKVHYRQLVQDGPVKMMLGSSTYKYNAKQLVLSEKAL

SEQ ID NO: 784 - protein, 1231 aa, Artificial Sequence
  Cas9
MITRILGLDTGTNSLAWAVVDRDANGNYTLVKRGDVIFTEGVKIEKGIESSKAAERTAHKALRVHYSRRRLHKIDTLKVLVELDLCPYLSNEQLNLWKAKKTYPLTDDFMLWQRSGSAEENNPYYCRHRCLTQKLDLTDQSQRFLLGRAFYHLAQRRGFLSNRLDTSADSDESGKVKSGIAELSVEMEKAGCEFLGEYFYQLYKQHGNTIKLRSRYTDREEHYKKEFLAICEKQELDPKWVEALQRAIYFQRPLKSQRKGVGKCTFEPKKPRCAESHPDYEAFRMLCFLNNVKIQTPNDTSLRPLNEDEREKIWPLFFRKSKPNFDFEDIAKALAGKNNYAWYKDAGEKPFKFNYRMQQGVSGCPVTAQLIDIFGSDWQTAIAETYTAVEKKNGTKTIDEMADDVWNVLYSFSSKDKLKAFATEKLQLDEASATKFANAKLPHGFASLSLKAIRNILPFLRQGFIYAHAVHLAKIPDIVTKAVWNDADKREMILSGLMEIIENYNPKDRGVEGTIDFCIKSHLQDVIDLRPGAADALYHPSMIETYPDAKLNKMGVFQLGSPRTNAIRNPMAMRSLHILRSVVNQLLRDGIIDRNTEVHVEYARELNDANKRKAIADYQREQEKKRKQYRDDIIALYKSECHKEIEPTDTDILKFQLWEEQDHLCLYTGTQIGICDFLGDNPKFDIEHTVPRSVGGDSTQMNLTLCDATFNRQVKGAQLPSQLSNHADILVRIDHWKSKCEDLRKQLDKIRTYGGMEKAMKDRLIQKRHRLKMDLDYWQGKYSRFTMTEVPEGFSRRQGAGIGLVSKYAGLFLKSLFHNEQNPNKSNVYVVKGVTTAEFRRMWGLQGEYEKKSRLNHCHHCIDAITIACIGKAEYDKMAQYYHDEELFQWRGTTTKPHFNKPWPTFTEDVLAIEQSLLVKHLTKDNMPKQAKKRVRTATGKYLAQGDTARGSLHKDTYYGAIEQDGEIRYVLRKPLNKFENEAELEKIVDQAVKEKIKEAIAGKNFKTAITEPIFMNKEKGIRINKVRYYVKAQERLKIRQQRDLSSKEYKQFFCVENESNYLLAIYEGELKGKKERDFCVVNNLESAACLKRSNKGKAAPLVPERSEERNLPLLAVLKRGTQVLFYENSPEEILFDNPQDLVRRLYKVTGINTKKDVKNGKTYLYGNIELRFHQNAQKKDDVKMQSGVYKNNEVLRQGIVLSHKQFKALVEGVDFEFNVLGEIKKKERHA

SEQ ID NO: 785 - protein, 1232 aa, Artificial Sequence
  Cas9
MTKTRILGLDTGTNSLGWAIVDRDEVSGQYELVDRGDLIFTEGVKIEKGIESSKASERTQHRALRKQYFRRRLRKIEVLRVLTFYHLCPPVSEEELHLWHVKKIYPVENHEFMIWQRTNDNEGKNPYYYRHICLHTKLNLTLMKDRYILGRALYHLSQRRGFLSNRLDQSQDEDDKGTVKTGISSLSKDMNDAGCTYLGDYFYKLYSENGNRVRIRNHYTARNEHYLAEFEAICQVQKLEPELVEALRRAIFFQRPLKSQRKGVGKCTFEPRKPRCADSHPDYEEFRKLCFINNIKIQTSDDDTMRPLNKEERQRINSLFYRVSKANFYFEEIAKLLGGRNNYCYFKDEVQKDFKFNYRMSQSVSGCPTTAQLRNIFGEDWKTGIAETYQHSAKKDGSLKTVDEMADDIWNVLYSFSSKDCLYNFAVNKLQLEEDKAKKFSKIKLSHGFASISLNAIHKILPFLRMGMIYSHAVLFANIPTIVGMDVWNDESKRQHIMTELSDLVFNYDPKNREVEGTIEMCIKDFLLNNYDLPAGAVCRLYHPSMIDTYPDAKANKYGVLQLGSPATNAIRNPMAMRSLHELRHVVNLLLRKGKIDQNTEVHVEYARELNDANKRKAIADRQRELDKLHKKYHDDIITLYKEETGKDINPTQADILKFQLWEEQEHVCLYTGRQIGISKFLGPDPEFDIEHTVPRSVGGDSTQMNMTLCDRRFNRDVKKAMLPSQLPNYQEILPRIEKWKKKYEKLTKDIDHCITHSGMTKEAKDSIIQKRHRLTLEHDYWRNKYSRFTMTEVPEGFSRRQGAGIGLVSKYAGLFLKSLFHDPTDRRRSHVYVVKGTTTAEFRKMWGLQSEYEKKSRDNHVHHCVDAITIACIGKNEYNKMASFYHDEEAFERGECEKPHFDKPWPTFTQDVLGLEKRLIVVHSTQDNMPKHAKKYVRTPRGKFIAKGDCARGSLHLDTYYGAIKHKDDTEPRYVLRRELSSFDSVNDLDIIVDDAVREKIKEAVKGKSGKAFKEALANVYMNKEKDIRIKKVRCYVPSVKRPIDIRHQRDMSRFDYKRQFHVANDGNYMMAIYEGVVKGKLKRDFELVKNIEAASYFKVSQDNESFSSIVPEKSSNGFPLKAVLKIGTHVLLYENTASEIDFSDPVDLTRRLYKVVGLSSAIINNCSYGFITLRFHQEARQAKNLKLTKGVFKNVDNYRGAIILYHTQLKALVEGYDFDINILGEITSKQ

SEQ ID NO: 786 - protein, 1234 aa, Artificial Sequence
  Cas9
MPNFWSIFTENLQTYLMKTRILGLDTGTNSLGWAVVDRDENNQYTPICRGDLIFTEGVKQEKGIEFSLAAERTSYRASRRHYFRRRLRKVEVLKVLVKHKLCPPLSDEALNRWHTKKEYPLDEDFILWQRTNEADNKNPYHDRHICLHRKLNLKDSQTDRYTLGRALYHLTQRRGFLSNRLDQNEEAEETGKVKSAISELSKEMKEAGCEFLGDYFYLLYRTEGNRVRIRSRYTDREKHYLQEFKEICRVQELDEDLAKALEKTIFFQRPLKSQRQGVGKCTMEKGHSRCAVSHPLYEEYRLLCYLNNIRIKTPSDDRLRPLNAEEREKITPLFYKEKNFDFEKIAKKLAGKTPFGWIRDAEDWPYQFNYRMTQEAPACPTTAQLIKVFGEDWKAALAETYTMSAKQDGTLKTEDEICTDIWNVLYSFSSKEKLKEFGLKKLQLDEVQAKAFSEIRLTRDFASLSLKAIRKILFFLRTGEDYSKAIFLANIPTIVGEEIWNDIERRSRLLYKVDLALRPQEERDAEEHRTIAERIKAAVAAEVPDAPIDLLYHPSMIEAYPDAKRNERFDCYQLGSPKTNAVRNPMAMRSLHMVRKVINHLLRKHIIDEKTEIHIEYARELNDANKRQAIADWQRELSKRHTAYAQNIRQLYKAETGLVIEPTKADILKYQLWEEQQHVCLYTGKKIGIADFLGANPKFDIEHTIPRSRGGDSTQENLTLCESKFNRDIKRDKLPTELANYEEILARIEHWKKQCYALKLKRDGIRTHSGLEKSIKDSRIRRRHLVGLEYGYLKGKYDRFTMKEVPEGFSRRQGAGIGLISKYAGLFLKSLFKDPKNPNRSNVYVVKGAITAEFRKLWGLQQADEAKSRENHTHHCIDAYTIACIGPCEYAALAAYYRSDEEFKYGRRREKPQFEKPWPTFTEDLLKLQEELLIVHQTTDKLGKRDRRKVKTPRGKFLTGGDSARGRLHQETYYGAINYDGNIKYVVRKPLDSLTEKDLDKIVDETVMGIVKGAVEAKGSLKEALADGIYMNKEKGILIKRVRIFSDVSEPINLKQLRDVSTKEYKRHIHLRKDENYLFAIYEGIDKKKNKKQTETATVDYLDAAKFYKDSKRRDKANSLVGDYSKKNKLPLKCILKKRQMVLFYEHSPEEIRFKDKKDLSRRLYIVTSIAKDGRVKFLHHQAATATGIQSSPSPFTNDGEHQPYYRLSASNIKVLVAGIDFDINILGEITPKL

SEQ ID NO: 787 - protein, 1236 aa, Artificial Sequence
  Cas9
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 788 - protein, 1238 aa, Artificial Sequence
  Cas9
MTKVLGLDLGAASVGWAMIEEEEKSHKILGLGSRIIPYEGTEGNDFAKGTGESRNALRTKARTARKGYDRYQLRRKYLVDTLVKNEMMPDEYLRKLPKMQLWELRSKAVTTEITKQELGRLFLWLNQKRGYKSSRSDANLDKKDTEYVVEVKSRHEKIKESGFTIGQYFYSELKSNEYFRVKENIFPREAYIEEFDAICKQQKRHLTDKLISRIRNEIIYYQRPLKSQKGLVSVCRFEGFFKKGINGKEYFVGPKVAPKSSPLFQTVKIWENINSIRLSDRNGKEIMLSLEQKKCIFNHLDNNEKLTPKDLFIIIGVKKENCFVNKQLEKGIQGNVTKSTILKCFGENNDYDKWLKLDLNIIVKKDTFGYLYDKKTGEIIGEKLIKHVDSAVEREPLYQLWHTIYSINNTDECSAALQNKFGFDSETADKLSNIDFGKAGFGNKSAKVIRKILPYLMEGDDYSQSMSYAGFNHSDSLTKDENLKRKLLDKLRPIEKNSLRQPIVEKILNQMVNVVNAIIDKYGKPDEIRIELARELKQNKEERNKTDKDMSKRQRENGEISKRLAEYGLRATRNNIIKWRLYEEIDNQDKKLNAICVYCGQPISLTEAIKGNEVDVEHIIPKSKLFDDSQSNKTLAHRRCNSTKGDMTAYDFMENKPAQVFNAYIERVNMLYDNKIIRKVKRDKLLMPESKIPDNFIDRQLRESQYIASKAREILQTICYNVWSTSGTVTARLRHLWGWDDATMSLQLPKYRELGLTEMVEWESEHGKQKHSKEVISDWSKRDDHRHHAVDALTIACTKQGFIQRFNTLNSSKTKEDMEFEIAKCSIEYRENLSKLEKYIIALRPIPVSEVEDAVANILISFKSGKKVAVKGKRKIGKRGNKKIIQTDIIIPHGSLSEESVYGKIKTIEREKPLKYLFQNSQLIFNNKIKILVEERLATFENDTKKALASLKKVPVYLDEEKTIVLEYATCFKEEYVKKYDVDTNFSKTDKVIDDKIKEILQHRLGKFGGKAKEKEAFKDVQQGDKTIKWYEDEGLERPIHSVRCFTGLSAIVPVKKDENGIDIGFVKPGNNHHIAIYSDKDGNRYEHICTFWHAVERKKYDIPVVIKDSNEIWNKIWSKPEGSYPQSFLDKLPQENLTLDLSMQQNEMLILGMSYEDIKTAIDNSDYKQLSSNLYRLQKLANANYMFRHHLETQIIDDNNSKASRRFINIHSLKALFAWNPYKVNINCLGDIQTNSR

SEQ ID NO: 789 - protein, 1239 aa, Artificial Sequence
  Cas9
MTEKRKFDIREVYLAIHHIVKYRGNFLNSATVDSFKTSNIDFTSQFDRLNELYRQVILEEPFQINMNQVDKMTNKLLDNDALKLDTQKQVAKLLPVIYNDKPVDKQYTRLATEFSKAILGYKTKLDVILNLDTQNAKDWAIRLDDEDIDDKLPALVENLDESRQEIVTIIRDLYAQITLNAIVPKGKSLSESMVDKYNDHKDHLDLLMGLIHELGDDSAKGIKLREAYTQYVGKSGDKTLNQDDFYAAIKKNLDEDSKRSPKIQRLIEQASFMPKQRTSANGVIPHQLHQLELDRIIENQGRYYPFLKEPNSNTHKPNGGKYKLDELVAFRIPYYVGPLITKQDQEKTSGADFAWMIRKPGQGGEITPWNFDQEVDRMASANTFIRRMTTKDSYLVAEDVLPDSSLIYEKFKVLNELNMLKVNDRRLSISQKQDLFNNLFKKQKTIRTKKLQTYIRTKWELPSVMISGLSDPDKFNSSLATYIDFRDVFGEKVDDPNRQADYEKIIEWSTVFEDRKIYQAKLNQLDWLTESQSKALLTKHYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSPQDRPQRTFSRQRQLQSTYLNVAKALMKSNLNQELKSVIDSQQTLTDKLYLYFTQLGQDMYTGKEINFDELVNYQIDHILPQAFIKDDSLDNRVLVSAPINNAKSDNVPVKKFGAKMGYFWKQLAENHLISKRKLNNLTTDPDKIGKFTAQGFIHRQLVETSQVIRLVANILGNEYGHDGTTIIEVTAKMNHQMRKDFDLIKIRDVNDYHHAMDAYLTAYVGDYLYLRYPKLRSYFVYGDFKKLKDQSLKIRNFNFLHDLTNDEAGDKIVDQETGEIIWDKHESVKQLKKVYHYKFMLVSQEVYTRQDALFNQTIYPASDADKRKLIPIKNNKPVDVYGGYSGNVDAYMAIVRIHGKKEDKYKVVGVPMRAVADLKKAESKGRDNYLNAVHEVLKPQFTKKKKDRKTGEITEMMDDFDVLLGKVYYRQLIVDGNKKFMLGSSTYQYNAKQLVLSDKAMQVLSKDDKLKNQDENQNLIDVYDEILEKVDQYFELYDINKFRQKLHDGRKKFIELPVDNDFNGKKLISYGKRATIISILNGLHANATMSNLKYLGISSPFGMLQVPNGIILSPASRICYQSPTGLFERKVKLSDL

SEQ ID NO: 790 - protein, 1245 aa, Artificial Sequence
  Cas9
MIIYFIFEKIVNTILVMKKIVGLDLGTNSIGWALINAYIDEYNKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLADFTEHHPKLIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIITRLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSLNEALKKPQAIVEMDLKKKILAMLELGYDTKRIKNYFEENKDTWQ

SEQ ID NO: 791 - protein, 1246 aa, Artificial Sequence
  Cas9
MRLVYLALAHMIKFRGHFLYEGDLKAENTDVQALFKDFVEEYDKTIEESHLSEITVDALSILTEKVSKSSRLENLIAHYPTEKKNTLFGNLIALSLGLQANFKTNFQLSEDAKLQFSKDTYEEDLEGLLGEVGDEYADLFVSAKNLYDAILLSGILTVDDNSTKAPLSASMVKRYKEHKEELAAFKRFIKEKLPKKYEEIFKDDTKNGYAGYVGADKKLRKRSGKLATEEEFYKYVKGILNKVEGADYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKELERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPTNIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGIKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSILIHQSITGLYETRIDLSKLGED

SEQ ID NO: 792 - protein, 1248 aa, Artificial Sequence
  Cas9
MKKILGLDLGSASIGWAVITENVENGITKCDILGMGSRIIPYEGTEGKDFTKGTGESRNSLRTKAKTARKGYDRYQLRRKYLVDTLIKNQMYPDEATRNLPKMKLWELRDKAVHSPVSLMELGRLLLWLNQKRGYKSSRSDANLGKKDTEYVATVKSRHEKMKELDVTIGQYFYRELSANEFFKVKENIFPREAYIEEFDAICKTQQIAHPMILRSELIDKIRNEVIYYQRPLKSQKGLVSVCEFEGFWRIGKDGKEYFVGPKVAPKSSPLFQLAKMWENINNIKIGSRTGEDLKLTTEQKWAIFQHLDNNEKLTPTDLLKILNLKKENCYVNKQMGKGLNGNITKHAILQCLGGSDKYENLLKLELKMVDGDKEGYLYDRKTGEVLNSKMIKFIDPMVEQEPFYQLWHIIYSIHDQEECSRVLQAKFDIEQPIADKLAAIDFSKHAFGSKSAKVIRKILPYLMDGDGYSEAMSYAGYDHSNSQTKEENLQRKLLDLLKPIPKNSLRQPIVEKILNQMVNVVNAIIEKYGNPDEIRVELARELKQSKEERNDADKAMSKRQRENDAITKRLEEFGLRATRNNIIKWRLYEEIDNQEKKLNAMCVYCGQPISLTEALRGNDVDIEHIIPKSKLFDDSQSNKTLAHRHCNKNKNDLTAYDFMKGKPEAVFNEYVERVNLLYDNHIIRKAKRDKLLMTESKIPDNFIDRQLRESQYIAKKAREILQTICHDVWSTSGTVTAELRHLWGWDDVTMNLQMAKYRELGLTHQVEWESEHGKNKHEKEVITDWTKRDDHRHHAVDALTIACTKQGFIQRFNTLSAAKTREDMMFDIEQRSHEFKEKRSLLEKYIISEQPLKVDEVEKAVSNILISFKSGKKVAVWGTRKIGKRGSKKVIQKKIIVPRGSLSEESVYGKIKKQEEKDYKYLFENPQLIFNPTIKAKVEERLLMFDGDVKKAITSLKKIPIYLDNNKTVVLEKAICLKDEFVIKYSVDINFNKVDKVVDPKIKEILQNRLKKFGGKEKEAFKDVQLEDKMIIKWYEDEGLERPIKSVRCFTGLSAVVPVKKDENGNDIGFVKPGNNHHIAIYTDTEENKQQHVCTFWHAVERKKYDIPVIIKNTNEVWDKIQSQPDGTYPDSFLEMLPPPNLNLLVNMQQNEMFILGTTTEDIKLAIDKRDYKIIGDKLYRLQKMSIKPSSGQIDIVFRHHLETQLIDDENSKKSKRFYNVQSLGALFALNPFKVRIDNLGNLVKEK

SEQ ID NO: 793 - protein, 1253 aa, Artificial Sequence
  Cas9
MKARGNFLHQDTPGLTAANANMGDAVEKLCVALEDWCTLRNLECNIRKNQKNIQNLLEGKTVEVSAENALKESFDSSRASRKDKATILSTWIAIQPGEYLDAKQAKDASKEIANVLFGLQGNMKKIFIEFEEDQKIRLDNDEQVEAFYSLCPDDGVALFESFQSIYSAYILMGILKNANGGSISSCKVAAYDQYKEDLKLLKDLVREFASEKYDEFFRGDIFDSSKGFRARNYNPATAKGYTKYNSVRGASYDDFKKEVEKIFKGTVAEEDIRYVDMMQRFAEGTFLRRLKTSDNGSIPYQLHLEEMDAIVENQKQFYPFLESEKEKLESLVTFRISYYVGPLTQKNARLDNHNNARFAWSQRKEGKEHARVYPWNWEEVIDRKQSAAKFMERLTGTCTYILDEPVLPRCSLLYEEYCLLNELNGSKWRDMGGDWHRFDYETRMEIIENLFKKKKGSVKYAAVEDWLKCEKHKSCAEVKGGQGETGFESKLSSYVFFKEVLHVDEIDEADIPMIEELIWWNTLFEDRSILKESIEDKYGDRLTDDQIKAICKKRFTGWGRLSKELLCGIKTHTDNGPYSIMDVLREGNPNNNARSETMVFMEILRDDKFGFDKLIEEENMRRVSEVDNFDVNDLPGSPAVRRTVNQAKRIVDEIVGIAGCEPQNIFIEVTRDEDGRNKGRRTKRRYDNIKNAIAALKKEQKEYFNKDVSDSLNKTNPSDLDNERLALYFMQNGKCMYCGKDLDIKQLDKYQVDHILPQSYVKDDSFENKALVHMEDNQRKSASMLLDDSIIRKMKPYWEALRAAGLIGEKKFKNLTRVRVSDKELGGFIARQMVETSQSMKLTSLVLEKTYPNTNVRPVKAGFSSDLRKRLDLIKCREINDYHHAHDAYLACEIGQFITMRHNKLYENPISYSHAVKDFIAKRAKYANDHGTPMSTYGMPGSSSFVISSFLTSGFDEETGEIFKDAWSAEVAAVRIRESLNRKDCYISRMPEETSGAFWKETLISPRDPSLGKNLSLPIKKGLDPRKYGGYNEQKFAYFFVYEAVKIKKKGEVKEYVFAAVPVQVAAIVARDPNALTGFAKKDAEARKIKFLRIIREKVYKYQLIEVNGERLYITGLKSVRNARQIALSQDMTTVFLKAINDKDVAEDELKSLFEEIVQRYRLCANRLGNQLKIFSLSDSFNSANSESKKRALVSLVAIIDAKTNKIDLSGIGSGKAVGNMRLSFSKEMSNSKNHFAFIDQSVTGMFERKTYL

SEQ ID NO: 794 - protein, 1258 aa, Artificial Sequence
  Cas9
MTEENPDIRKVFLAIHHILKNRGHFLLQGQSFKEGNLNNLIKELLNLDILHISIEITEENINKITEIALEKKTLTDKVNDLKKIYPKEKQLLEAFRLIFGGKTSLDKLFAIDEYKELDASVKSVSFKEKIYEEVRHDYEQVLSNYIELLDLAKLVYDSIILSDIKKEGKTLSESKVELYHKHREDLTKLKTLVKNDSKLSEDKKVELYSAIFKEDKDKGTNYVNYIRKSEEGKGCNYEDFKKFLVKELAKLEESSAKEEILRDLELELFLPLQRTKDNSVVPYQIHKEELVKILDNAAKYHKFLNEKDDSGYSIIEKVIQLLEFRIPYYVGPLNSSKKAKVDGFAWSVRNKGYENTPVTPWNYEKVIDESASAEKFITNLTNKCTYLKGEDVLPKSSLLYSEFALLNELNALKYDGNRISLEARNVIIEKLFKEQGKKVTKTSIKNLLKAEGYIDGKGEITGIDITVKNDLKSYRDFKKILGDKFNTEHVENIILWITLYGESRKLIKAKIEAVYGDIYSKEEIAKMSRLVYKDWGRFSRKLLTELVSKKLYNEETGECLNIIGAMRQNNILFMELLADRFDYSQQIIDYNKELQKEVTEITPEILDDLYVSPSVKRSIWQTVRIVEELKKIIGCAPAKIFVETTRSNQDKKKPTDSRKKQLELFYKAVKKDVKDLEKEIGSLNFDKLNERLSSVEPSKLKAKKLYLYYTQLGRCMYSGETIDITQLNTTAYDIDHIYPQSKVKDDSFTNTVLVKREYNAAKTDRYPLGSDIQTPSNRRFWKFLKEKGLITDEKYNRLVRTEEFSDEELTGFIARQLVETSQSVKAVAGILGELNPKTSICYSKAENVSSFRQNFGKIKEGNRKSDNTEQLIKVREINDYHHAKDAYLNVVVGNVYDTKFTRNVFNFIKDKKDGRKYSLNNVFYENVSNSNNVAWELNKTVHQVEKVMNNNNILVTRRTSEQKGGLFDATVYKAKVAAKAKEGVYYPLKTSDPVVNDVTKYGGFTKVKIAYYSIFEYTLVNKKGEEKITRIIPIPIYVSQNIKDDSTLLEFGKTQINIKSGEEVKDFKLKYRKLCIGDLVKINNFFNFIGGKTNDSFVYDGAVQVTLDTESERYIKTLSKYQNWKKENKDGELWESITKEKNTELYNLLVEKMNSGIFIKKKPNKFNELNSEEIRNNFSSISLEEQAKVLLEVLNLLTNKKSIFDLKSINITAARGKISFNLSNLSQFSIIEQSVAGFYEKEITIIGDKENDMENNNC

SEQ ID NO: 795 - protein, 1259 aa, Artificial Sequence
  Cas9
MKYILGLDLGVASIGWAVTEINEKGEPVGLIDANSVIFKPLDNDKGKLYNVERRDKRGSRRILRRKKHRVERTKMLLVNSSFLTNEEIDNLYVGKLDNIYEVRLKGLKEQLSKNEIARLMIYYCKNRGFKSNRKTEDLEILKSLGEKISEKDSDEKKLKPIIAKNTELIESKGLTPIEVIYMIRENDNSILGFKNKEGNYKFGFKRNQVIDEVRKILGTQQILSKEIVDEYIDILSSQRDFSDGPGGDSKYKIDYTKLAGKCKYTGEVRAVKSAPSYEIFTMLQKLNDIRYVKFTSEDKIEKKKLSKEVIHKLYDLVVEKNKTLTYDLIEKSIDEENIKLLNIPKLSKSKYVELRKSYFKERNDNENLTEEEINAFNEKLNNERMKQELIRNNLKAYKELKSKFKKNNIDENRIKELGGIYFLDLVAELLTYSKTDEKLEYFVENVERYSLFKEQRDIVEIIKTFPNYTKNGNLSLSLVRELNKLLMEGHDYESSLSSLNYYIDTDVDWEKFPTISEIEDSLSTKITNPNVKHILVILRKLYNTLLFKYGRPEKVHLELSRDFSNDFSTRNKIQKEQLENKVRREVAAFEMYGANKDIVAGKDRLSNDDFVRIKLWEEQNKVCMYSGRTIEKYQLTSAEVQIDHILPYSKSFDNSYSNKVLVFSNENQDKKERTPYQWLKGTEKWNEFKQRVRLNLNISNKKKENLLFEDEVVNNEFLERELHATSYSSRLALNIFQRLIPVSDEDKYDEHGNEKVKYLYNRNVIAFQGKMTSMLRNLYSLNKYTHSFESDTLDIDNKAFILKEFEINKDNLKMTAYNVNTGLEITSETKVEKNKSGEFKTIKDELLKKELDKKENLIEISDYFKDKVLFDLKIVDFEEIDTVEPEIISILYKMITALKEEVYSKNRENHLHHSLDAFLLTIMNRSMQMKLIKYNQLISVLKNKEIEIFNEEKGEYIDSKEFAEELQKQKIIDIDGNERGIKFNVNGKTHRLNLVKPYENFLDDIKNKIFDKRENNKLPYHVVKSKVSGALHAETILGESKGEITKRISVFDINYKNLGKIFDKDGSQKEIYETLVKWLEAKSKDYPKLKNGNIIKKVKIVDGNKDKLIKLGNKRYVEMGRTTVKILVLKKEAEEGLKFASIGRYKYNLLKSEKDVNISIWKDAIHFCKVRYNKLKENGYRLIHELIPGETIELELNKGNISKCLVVGFSGGKIEISSVIGDALDLINDKISTRIKERYYITVSTIKSIKKINKNILGD

SEQ ID NO: 796 - protein, 1263 aa, Artificial Sequence
  Cas9
MHKNNPDIRELFLAIHHILKYRGHFLFAGQQFKGSEIKDNIRELLQYNSLNIKIDITDELINNIAEILLKKKNSTDKIIEFKKLFADEKQLIEALRLALGNKTQLAKLFDIEAYKELDISIKTISFKEKIYEDVRSNYEEILGEYIIVLDTAKLIYDAIILSEIKIKNMTISESKVISYEKHGKDLKQLKQLIKEDSKLSKKEKRQLFENIFVKEDEKEANYVNYIGKNNVGSSKSSCSYEDFKKSLIKELKYCEESKLKQDILAELELETFLPRQRTKDNSVIPYQIHKEELEKILNNAVQYHPFLNNTDEYGISIKEKIIQLLEFRIPYYVGSLNTSHKVGNGGFSWSVRNKGYERTAVTPWNFNKVINKEESAKNFIENLTNQCTYLLYEDVLPKHSLLYSEFTLLNELNSINYGGKRLTVEHRNLIIERFFKQSAPKATGKELKKFLMSEGVIDGKDELSGFDISIKNDLKSYRDFKKILGEKFDSEKVEKMIRWITLFGESKQLLVDKITKEYGDIYSSEEIKKISGLTYKDWGRLSEKLLTEIVSSQLYDESTGECFNIINAMRNNTLLFIELLGTNYDYFEKINTYNGKLRKEITEITPHILDDLYVSPAVKRSIWQVVRIVEELKKVIGSEPKRIFVETTRSNKEKKGDDGRKDSRKKALLELYKKIKTSDIAELEKALGHTVDFDKKKQDLTDIDNNKLKARKLYLYYTQLGRCLYTGKAIDLNNLFGSNSEYDIDHIYPQSKTKDGSWNNLVLVNKTENSKKSNGLISESIQRKNKHFWRFLKAKNLISEEKYKRLTRTEDFTDGELSGFIARQLIETSQSVKVVSKILQNLNPTTELCFSKAENVSDFRQEFGKIKVGKRKNLTEEEQKKAKEGQLIKVRDLNDLHHAKDAYLNIVVGNVYHIKFTRNPKNFIRKNFKNREYTLNTLFYSDKVERNGEVAWEKGKTEEIVSSVMCNNLINVTRRTSEQKGALYEATIYKANAAKEGSYYPVKTNNKNLKNVTRYGGFTSIKIAYYSIFKYDIRNKDKVKENIKIIPIPIYISQNIKTDLDLINFAEKQIKLKKGENIENLQLIYKKLNIGALVKIDHYPYYIGGKTDDNFYVDGAVQVLLSSDIERYLKEVVKFVNFQRENKEAKVSKEHISLEENIKLYNTLVCKMATKIFTHKKNNKYNDLTQDKAKNTFNKLSLEEQCKVLLEILNLLTNKKTTFDLSLINEKTSRVKCGFNLLNQKQFSIIEQSVTGLYEKEIKIIED

SEQ ID NO: 797 - protein, 1264 aa, Artificial Sequence
  Cas9
MKNVLGLDLGTNSIGWALIEVDENNLPIRIIAMGSRIIPLSTSDKEEFQRGLSITKNQSRTVSRTQRKGYDRKQLKKSDLKKILNKYNIFPSEELLRLPMLDLWKLRSDSANPDENISAEQLGRILYMLNQKRGYKSARSEANADKKDSDYVQAVKGRYDQLKDRKQTIGQYFYDELYNANANNSYFRIKEEVYPREAYIEEFDTIISAQREKHDFLTDEVVHQLRNEIIYFQRKLKSQKGLVSICEFEGFEKTVFDKEKNKNKVVFVGPKVAPKTSPLFQLCRIWEVVNTITLKIKNPEGSKYKWGEKIPDIKEKEILADYLFKNESLSFSKLLEILELKKENVYVNKQILKGIKGNETYSALHSILGDNELLNFDVSIMTSNQTALLVDRKTGEILEERAGLELDASLEKEPLYQLWHTIYSLKDLDECKNALIKRFDFDDETAEKLSRIDFNKQAFGNKSNKSMRKILPFLMEGYDYSQSSSLAGYNHSNSLTKNEREQQITLDRLELLPKNSLRQPIVEKILNQMINVVNAILDEYGKPSEIRVELARELKQSKDERNETDLQNSKNKKLNDEIGKRLEELGLPVTKRYIQKYKFIFPSLSKNLKEAKVNNQCIYCGETFNLTEALSGDAYDVDHIVPKALLFDDSQTNKVLVHRKCNSTKTNQTAYDYIATKGDEHLKLYSERLDDWFERGIISYSKMQRLKVSHKEYLERKKLGKETETDKKLWENFIDRQLRDTQYISRKSREILQKICNDVKTTEGGVTAKLRNLWGWDDVLMNLQMPKYKELGQTITKEWTSEHGKRKHQKEEIDNWTKRDDHRHHAIDALVIACTKQGFIQRINTLNSSDTKDLMIKEVEEAKIEFNEKTTLLEKYLKTQKPFSTQEVMKEADKILVSFKAGKKVATITKFKATGKNKETGVIVPRGALHEQSVYGKIKVIEKDKPLKYLLENSDKIVNPRIKNLIEIKLSENKNDPKKALLALKKIPIFLDEEQSITLEKASCYNDATVLKYKLQNLKAAQVDDIVDEKVKKIVRERLSQFGNKEKEAFKDTLWFNEEKKIPIITVRLFARPDANNLQTIKKDENGNGIGFVVTGNNHHIAIYEDKDNKPVQHSCTFWHAVERKKYNIPAVIRDSSEVWNDLLRKELPESFLNKLPADNLNLKFSMQQNEMFILGLSQDEFVKAIANNDKSLLSKHLYLVWSISENNYWFRHHLETKNSDLKKTDGVKESKRLYNIRSLGSLFSLNPIKVRLNYLGEITKIGE

SEQ ID NO: 798 - protein, 1266 aa, Artificial Sequence
  Cas9
MAKYILGLDLGTNSIGWALIEVDENNIPIRIIVMGSRIIPLSSNDREEFQRGLSITKNQNRTISRTQRKGYDRKQLKRNDLNKVLNKYNIFPSKMLLNLPMLDLWKLRSDSANSNKDISAEQLGRILYMLNQKRGYKSVRSEANSDKKDTDYVQAVKGRYAQLKDRNQTIGQYFYEELYNANVNNSYFKIKEEVYPREAYIEEFDTIINSQKTKHEFLTDQFVHQLRNEIIYFQRKLKSQKGLISICEFEGFEKTVFDKEKNKHKIVFVGPKVAPRSAPLFQLCRVWEVINTISIKVKNPEGSKYKWGERIPSIKEKEILADYLFKNEVLSFTKLLEILGLNKNDVYVNKQILKGIKGNETYATLYNILGENEFLNFDVSIIPSNHTSMLVDKKTGEILEERAGLELDVSLEKQPFYQLWHTIYSLKDLDECKNALIKRFDFDDETAENLSRIDFNKQAFGNKSNKSMRKILPFLMEGYDYSQSCSLAGYNHSNSLTKDEREQQVTLDRLELLPKNSLRQPIVEKILNQMINLVNAILDQYGELSEIRVELARELKQSKDERNDADLQNTKNKKLNDEIGKRLAELGLPITKRYIQKYKFIFPSLSKNLKDAHVNNQCIYCGETFNLSEALSGDAYDVDHIVPKALLFDDSQTNKVLVHRKCNSTKTNQTAYDYISTKGDEQVRIYFERVDDWFKSGIISYSKMQRLKVSHKEYLERKKIGKETETDKKLWENFIDRQLRDTQYISRKSREILQKVCNNVTTTEGGVTAKLRNLWGWDDVLMNLQMPKYRELGQTVIKEWTSEHGKRKHQKEEVENWTKRDDHRHHAIDALVIACTKQGFIQRINTLNSSDTKDLMLKEVEEAKVKFSEKTTLLEKYLRTQEPFSTQEVMREADKVLVSFKAGKKVATITKFKAIGKNKDSGVIVPRGALHEQSVYGKIKVIEKDKPLKYLFENSDRIVDPKVKKLVEVRLSENENNSKTAISTLKKAPIFLNEEKTEVLEKASCYNDATVLKYKLQSIKASQADDIVDERVKFLVKERLAQFGNKEKEAFKDILWFNEEKQIPIISVRLFARPDANNLQVIKKDENGKSIGFVLTGNNHHIAIYEDKDNKLIQHSCTFWHAVERKKYNIPVVIKNSSDVWSQLLDKQLPESLLNKLPTDKLNLKFSMQQNEMFILGLSQKEFDEAIKNNHKSFLSKYLYLVWSISNNDYYFRHHLETKNTELKNISTAKESKRYFRFKSVGALVGTNPIKIRLNHLGEINKVGEY

SEQ ID NO: 799 - protein, 1268 aa, Artificial Sequence
  Cas9
MTKNILGLDLGTNSIGWALIEVDENNTPIRIIAMGSRIIPLSTSDKEEFQRGLSITKNQSRTVSRTQRKGYDRKQLKKSDLKKILNKYNIFPSEELLKLPMLDLWKLRSDSANPNENISAEQLGRILYMLNQKRGYKSARSEANADKKDTDYVQAVKGRYAQLKERNQTIGQYFYEELYNANTNNSYFRIKEEVYPREAYTEEFDTIINAQKNKHDFLTDEVVHQLRNEIIYFQRKLKSQKGLVSICEFEGFEKTVFDKEKNKDKVVFVGPKVAPKTSPLFQLCRIWEVVNTISLKIKNPEGSKYKWGEKIPNLKEKQILADYLFKNDSLSFTKLLEILDLNKNDVYVNKQILKGIKGNETFSTLHTVLGDNELLNFDVSIIPSNHTSMLVDKKTGEILEERAGLELDASLEKEPLYQLWHTIYSLKDLDECKNALIKRFGFDDETAEKLSHIDFNKQAFGNKSNKSMRKILPFLMEGYDYSQSCSLAGYNHSNSLTKDEREQQITLDRLELLSKNSLRQPIVEKILNQMINVVNAILEQYGKLSEIRVELARELKQSKDERNDADLQNSKNKKLNEEIGKRLAELGLPVTKRYIQKYKFIFPSLSKNLKDAHVNNQCIYCGETFNLTEALSGDAFDVDHIVPKALLFDDSQTNKVLVHRKCNSTKTNQTAYDYIGTKGEEQVRVYSERIDDWFKRGIISYSKMQRLKVSHKEYLERKKLGKETETDKKLWENFIDRQLRDTQYISRKAREILQKVCNNVTTTEGGVTAKLRNLWGWDDVLMNLQMPKYKELGQTVIKEWTSEHGKRKHQKEEIENWTKRDDHRHHAIDALVVACTKQGFIQRINTLNSSDTKDLMQREIKEAKKLLGENYNEKEFENDNEFVKNHKERLSQLDDYLRLQKPVKFDTKYVEQEADKVLVSFKAGKKVATITKFKATGKNKDTGVIVPRGALHEAGLYGIRTIYSKGGIAEKHIIKKYKVGVSAQDHIFTGKETYSVKKDKNGNEKVDDKIKIVLDSIVDNKVKEVVLNRLNRGFNNEEDYRIDVKKALNNFKNLDEDPLWYNESKGIKILSIKLKTGLKDSVVPLRLNEKNEVITLVKTGNNHHIAIYEDNDGKLIQYSCTFWHAVERKKYNIPTVIKNSSEVWNQVLDKKLPESFLNRLPADKLNLKFSMQQNEMFILGLLEEEFDKAIKDNDKSLLSKYLYLVWSIAEGDYWFRHHLETKNTELKKTNGAKESKRYFRLSTKGLIDLNPVKVRLNHLGEITKIGEY

SEQ ID NO: 800 - protein, 1269 aa, Artificial Sequence
  Cas9
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKKKKANRFLMTLSTILNDYILLDAKDNFDILGLSKNRIDEILNSKLGLDKITK

SEQ ID NO: 801 - protein, 1269 aa, Artificial Sequence
  Cas9
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYNNRVDSANLKEFSDSNRLFERVLQEQKDGLFKLFEQTDKDDEKILAQTHSLSTKAMLLAITRMTNLDNDEDNQKNNDKGWNFEAIKNFDQKFIDITKTNNNLSLKQDKRYLDDRFINDAILSPGVKRILREATKVFNAILKQFSQEYDVTKVVIELARELSEEKELENNKNYKKLIKKNSDKISEGLKALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNKTKTLFDQLTQFADYKLFKNTDGSWKKIDPKTGVVTEVTDENWKQIRVRNQVSKIAEEIDKCIQDSNIERKARYSRKIENKTNISLFNDTVYSAKKVGYDDQIKRKNLKTLDIDESVEENKNSKVKKQFVYRKLVNVSLLNNDKLADLFAEKEDILMYRANPWVINLAEQIFNEYTENRKIKSQNVFGKYMLDLTKEFPEKFSEAFVKSMLRNKTAIIYNVEKKVVHRIKRLKILSSELKENKLSNVIIRSKNESGTKLSYQDTINSVALMIMRSIDPTAKKQYIRVPLNTLNLHLGDHDFDLHNIDAYLKKPKFVKYLKANEIGDEYKPWRVLISGSLLIHKRDKKLMYISSFQNLNDLIEIKNLIETEYKENVDSDPKKKKKASQILRSLSTILNDYILLDAKDNFDILGLSKNRIDEILNSKLDLDKIAK

SEQ ID NO: 802 - protein, 1273 aa, Artificial Sequence
  Cas9
MKKILGLDLGTNSIGWALIEVDENNFPIRIIAMGSRIIPLSSNDKDEFQRGLSITKNQSRTVSRTQRKGYDRKQLKKSDDFKYSLRRILNKYNIFPSEELLKLPMLDLWKLRSDAVNPNENISAEQLGRILYMLNQKRGYKSARSEANADKKDTDYVLAVKGRYAQLKDRNQTIGQYFYEELHNAKTTNSYFRTKEEVYPREAYIEEFDTIINAQKSKHDFLTDEVVHQLRNEIIYFQRKLKSQKGLVSICEFEGFEKTIFDKEKDKNKVVFVGPKVAPKTSPLFQLCRIWEVVNTITLKIKNPEGSKYKWGEKIPNIKEKEALADYLFKNETLSFNKLLDILELKKENVYVNKQIIKGIKGNETYSALHRILGDNELLKFDVSIIPSNHTSMLVDKKTGEILEERAGLELDVSLEKEPLYQLWHTIYSIKDLDECKNALIKRFGFDDEIAEKLSHLDFNKQAFGNKSNKSMRKILPFLMEGYNYSQSCTLAGYNHSNSLTKDEREQQVTLDKLELLPKNSLRQPIVEKILNQMINVVNAILEEYGKPSEIRIELARELKQSKDERHDADLQNSKNKKLNEEIGKRLTELGLPVTKRYIQKYKFIFPSLSKSLKDAQVNNQCIYCGETFNLTEALSGDAYDVDHIVPKSLLFDDSQTNKVLVHRKCNSTKTNQTAYDYIASKGEEEVQIYSARVDDWFKRGIISYSKMQRLKVSHKEYLERKSLNKETETDKKLWENFIDRQLRDTQYISRKSKEILQKVCNNVTTTEGGVTAKLRDLWGWDDILMNLQMPKYKELRQTVIKEWTSEHGKRKHQKEEIENWTKRDDHRHHAIDALVIACTKQGFIQRINTLNSSETKDLMQQEINEAKKLLGENYKDKEFENSNELVKNHKGRLSKLDDYLRLQKPIKFNTKYVEKEADKILISFKAGKKVATITKFKATGKNKDTGVIVPRGALHEAGLYGVRTIYSKGGIAEKHIIKKYKVGVSAQDHIFTGKESYSVKKDKNGNEKVDDKIKVVLDSIVDSKVKEIVLNRLNFGFSDGEDYKNNVKKALNNFKNLDEYPLWYNENKGIKILSIKLKTGLKDSVVPLRLNESNEVITLVKTGNNHHIAIYEDKNSKPVQHSCTFWHAVERKKYNIPAVIKKSSDVWNQLLDKELPESFLNNLPEDNLNLKFSMQQNEMFVLGLSQEEFKEAIENNDKSLLSKYLYLVWSVSENNYWFRHHLETKNSDLKKTEGAKESKRLYNIRSVSSLFSLNPVKVRLNHLGEITKIGEY

SEQ ID NO: 803 - protein, 1274 aa, Artificial Sequence
  Cas9
MTKHILGLDLGTNSIGWAIIQVDNNNNVPIQIIAMGSRIIPLDSNDRDQFQKGQAISKNKDRTTARTQRKGYDRKQLKKSDDFKYSLKKILEKLDIFPTEELMKLPTLDLWKLRSDAVSNIEDITPKQLGRILYMLNQKRGYKSARSEANADKKDTDYVAEVKGRYTQLKDKGQTLGQYFYKELSDANQNNTYYRVKEKVYPREAYIEEFDAIINVQKSKHSFLTDEVIHSLRNEIIYYQRKLKSQKGLVSICEFEGFETTYFDKKTQQDKTIFTGPKVAPRTSPLFQFCKIWEVVNNISLKTKNPEGSKYKWSDRIPTIEEKQTIANYLQENENLSFIELLKILQLKKEQVYANKQILKGIQGNTTFSAIHKIIGNSEHLKFDIETIPSKHFAVLVDKKTGEILDERDSLELNSALEQEPFYQLWHTIYSIKDLDECKKALIKRFNFEEEIAEKLSKIDFNKQAFGNKSNKAMRKMLPYLMLGYNQSEAESFAGYNRRLTKEEKSKNVSDEPLQLLAKNSLRQPVVEKILNQMINVVNAIIEKYGKPEEIRVELARELKQSKDEREDADKQNGFNKKLNELVATKLTELGLPTTKHYIQKYKFIFPAKDKNWKEAQVANQCIYCGDTFNLTEALSGDNFDVDHIVPKALLFDDSQANKVLVHRSCNSTKTNNTAYDYITKKGSQALNDYVARVDDWFKRGIISYGKMQRLKVSFEEYQERKKIGKETEADKRIWENFIDRQLRETAYIAKKAKEILEKVCHNVTSTEGNVTAKLRQLWGWDNVLMNLQLPKYKELEKKTKQTFTQLKEWTSDHGNRKHQKEEIINWTKRDDHRHHAIDALVIACTQQGFIQRINTLSSSDVKDEMKKELEEDKTVYNERLTLLENYLLEKKPFSTEEIEKEADKILVSFKAGKKVATLSKYKATGINEIKGVLVPRGPLHEQSVYGKIKVIEKDKPLKYLFENSDKIVNPLIKHLVKTRLLENENNAQAALVTLKNKPILLNNKQTEILEKASCYNEATVLKYKLQSLKASQIDDIVDEKIKFLIKERLSKFGNKEKEAFKDILWFNEKKQIPITSIRLFARPDANNLQVIKKHEKGKNIGFVLSGNNHHIAIYEDKNNKLIQHICDFWHAVERKRNNIPVLIEDTSTIWNHLINEDFSESFLNKLPNDSLKLKFSLQQNEMFILGLPKEQSEEAIKSNNKSLLSKHLYLVWSITDGDYFFRHHLETKNTELKKIDGSKESKRYLRLSTKSLVDLNPIKVRLNHLGEITKIGE

SEQ ID NO: 804 - protein, 1281 aa, Artificial Sequence
  Cas9
MEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLAFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 805 - protein, 1286 aa, Artificial Sequence
  Cas9
MTKNILGLDLGTNSIGWALIEVDENNTPIRIIAMGSRIIPLSTSDKEEFQRGLSITKNQSRTVSRTQRKGYDRKQLKKSDLKKILNKYNIFPSEELLKLPMLDLWKLRSDSANPNENISAEQLGRILYMLNQKRGYKSARSEANADKKDTDYVQAVKGRYAQLKERNQTIGQYFYEELYNANTNNSYFRIKEEVYPREAYTEEFDTIINAQKNKHDFLTDEVVHQLRNEIIYFQRKLKSQKGLVSICEFEGFEKTVFDKEKNKDKVVFVGSKVAPKTSPLFQLCRIWEVVNTISLKIKNPEGSKYKWGEKTPNLKEKEILADYLFKNDSLSFTKLLEILDLNKNDVYVNKQILKGIKGNETFSALHTVLGDNELLNFDVSIIPSNHTSMLVDKKTGEILEERAGLELDASLEKEPLYQLWHTIYSLKVLDECKNALIKRFGFDDETAEKLSHIDFNKQAFGNKSNKSMRKILPFLMEGYDYSQSCSLAGYNHSNSLTKDEREQQITLDRLELLSKNSLRQPIVEKILNQMINVVNAILEQYGKLSEIRVELARELKQSKDERNDADLQNSKNKKLNEEIGKRLAELGLPVTKRYIQKYKFIFPSLSKNLKDAHVNNQCIYCGETFNLTEALSGDAFDVDHIVPKALLFDDSQTNKVLVHRKCNSTKTNQTAYDYIGTKGEEQVRIYSERVDDWFKRGIISYSKMQRLKVSHKEYLERKKLGKETETDKKLWENFIDRQLRDTQYISRKAREILQKVCNNVTTTEGGITAKLRNLWGWDDVLMNLQMPKYKELGQTVIKEWTSEHGKRKHQKEEIENWTKRDDHRHHAIDALVVACTKQGFIQRINTLNSSDTKDLMQREIKEAKKLLGENYNEKEFENDNEFVKNHKERLSQLDDYLRLQKPVKFDTKYVEQEADKVLVSFKAGKKVATITKFKATGKNKDTGVIVLRGALHEQSVYGKIKVIEKDKPLKYLFENSKKIVNPKIKVLVEERLAENENNSKLSLSTLKKNPIFLNEEKTEILEKASCYNDATVLKYKLQSLKASQADDIVDDRVKFLVKERLAQFGNKEKEAFKDTLWLNEEKQIPIITVRLFARPDANNLQAIKKDKNGRDIGFVLTGNNHHIAIYEDKDNKLVQHSCTFWHAVERKKNNVPAVIKNSSDVWNQLLDKELPESFLNKLPIDKLKLKFSLQQNEMFVLGLLQEDFEAAIENNDKTLLSKHLYLVWSITDGDYFFRHHLETKNTELKKTEGAKESKRYFRLSTKGLIDLNPVKVRLNHLGEITKIGEY

SEQ ID NO: 806 - protein, 1287 aa, Artificial Sequence
  Cas9
MKTVLGLDLGTNSIGWALIELDENNIPIRIVAMGSRIIPLSTSDKEEFQRGLSITKNQSRTVSRTQRKGYDRKQLKKSYLKKILNKYNIFPSDELLKLPMLDLWKLRSDSANPNENISAEQLGRILYMLNQKRGYKSARSEANADKKDTDYIQAVKGRYAQLKDRNQTIGQYFYGELNDANENNSYFRIKEEVYPREAYTEEFDTIINAQKDKHDFLTDEVIHQLRNEIIYFQRKLKSQKGLVSICEFEGFEKTVFDKEKNKDKVVFVGPKVAPKTSPLFQLCRIWEVVNTITLKIKNPEGSKYKWGEKIPDVKEKEILADYLFKNESLSFTKLLEILKLNKNNVYFNKQILKGIKGNETYSILHSILGDSELLNFDVSIIPSNHTSMLIDKKTGEILEERAGLELDTSLEKEPLNQLWHTIYSIKDLDECKSALIKRFGFDDETADKLSRIDFNKQAFGNKSNKSMRKILPFLMEGYDYSQSCSLAGYNHSNSFTKDEREQQITLDKLELLPKNSLRQPIVEKILNQMINVVNAILERYGKPSEIRVELARELKQSKDERNDTDLQNSKNKKLNEEIGKRLAELGLPLTKRYIQKYKFIFPSLSKNLKDAHVNNQCIYCGETFNLTEALSGDAFDVDHIVPKALLFDDSQTNKVLVHRKCNSTKTNQTAYDYIATKGDEQVRVYSERVDDWFKRGIISYSKMQRLKVSHKEYLERKKLGKETETDKKLWENFIDRQLRDTQYISRKSREILQKVCNNVATTEGGVTAKLRNLWGWDDVLMNLQMPKYKELGQTVVKEWTSEHGKRKHQKEEIENWTKRDDHRHHAIDALVVACTKQGFIQRINTLNSSETKDLMQQEIKEAKKLLGENYNEKEFENNNESVKNHKERLSQLDDYLRLQKPVKFDTKYVEQEADKVLVSFKSGKKVATITKFKATGKNKDTGVIVPRGALHEQNVYGKIKVIEKDKSLKYLFENSEKIVNPKIKNIVEIILSENENNSKMALSTLKKNPIFLNEEKTDLLEKASCYEYVTVRKYPLNTIKASQADDIVDERVKFLVKERLTQFGNKEKEAFKDTLWFNEEKQIPIITVRLFARPDANNLQAIKKDESGKEIGFVVMGNNHHIAIYEDKDGKLVQHSCTFWHAVERKKYNISTVIKNSSDAWNQFLDNELPEPFLNKLPADNLNLKFSLQQNEMFILGLSQEEFDKALKSNDKSLLSKHLYLVWSISENNYWFRHHLETKNSDLKKTNGVKESKRLYNIRSLGSLFSLNPIKIRLNHLGEITKIGEYS

SEQ ID NO: 807 - protein, 1288 aa, Artificial Sequence
  Cas9
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 808 - protein, 1300 aa, Artificial Sequence
  Cas9
MWGVSLFEAGKTAAERRGYRSTRRRLNHRKFRLRLLEDMFEKEILSKDPSFFIRLKEAFLSPKDEQKQFKGNILFNDKDYTDADYYEQYKTIYHLRYDLISQHRQFDIREVYLAIHHLIKYRGHFIYEDQTFTTDGNQLQHHIKAIITMINSTLNRIIIPETIDINVFEKILLDRMMNRSSKVKFLIELTGEDKQDKPLLKELFNLIVGLKAKPASIFEQENLATIVETMNMSTEQVQLDLLTLADVLADEEYDLLLTAQKIYSAIILDESMDGYEYFAEAKKESYRKHQEELVLVKKMLKSNAITNDERAKFEYFYTDYIGAKSSNYEESKNIKKGLSAAYGKYSKEERLFKHIELLLAKENVLTTVEHALLEKNITFASLLPLQRSSRNAVIPYQVHEKELVAILENQATYYPFLLEQKDNIHKLLTFRIPYYVGPLADQKDSEFAWMVRKQAGKITPFNFEEMVDIDASSEAFIKRMTNKCTYLIHEDVIPKHSFSYAKFEVLNELNKIRLDGKPIDIPLKKRIFEGLFLEKTKVTQTSLKKWLAEHEHMTVSVVQGTQKETEFATSLQAFHRFVKIFDRETVSNPANEEMFEKIIYWSTVFEDKKIMRRKLSEYPQLTEQQQVQLAQVRFRGWGRLSQRLINRIKTPVSGDEDHKLSINEILWQTNENFMQIIRNKDYLFKKIIEEQFENETALLNKQRIDELAASPANKKGIWQAIKIVKELEKVLQQPAENIFIEFARSDEESKRSTPRDKFIEKAYAQLKKETDTFNLEHLKELKQRSKQLSSQRLFLYFIQNGKCMYSGEHLDIERLDSYEVDHILPQSYIKDNSIENLALVKKVENQRKKDSLLLNSSIINQNYSRWEQLKNAGLIGEKKFRNLTRTKITDRDKEGFIARQLVETRQITKHVTQLLQQEYKDTTKVFAIKATLVSGLRRKFEFIKNRNVNDYHHAQDAFLVAFLGTNITSNYPKIEMEYLFKGYQHYLNEVGKSAAKPKFTFIVENLSKQQYNSTTGEVKWNPEVDIAKLKRILNFKQCNIVRKVEEQSGALFKETIYPVEESSSKTIPLKKHLDTAIYGGYTAVNYASYALIQFKKGRKLKREIIGIPLAVQTRIDNSETSLQAYIAEQIKSEVEILNGRILKYQLISNNGNRLYIAGPSERHNARQLIVSDEAAKVIWLISTKQADEAMFLKYYRLEHLEAVFEELIRKQAADYQIFEKLIKKIEVNKVYFYSCTYNEKVKVIEELLKITQANATNGDLKLLKMSNREGRLGSVSVALDFKIINQSVTGLYQSIEDYNN

SEQ ID NO: 809 - protein, 1309 aa, Artificial Sequence
  Cas9
MGSVGFAGIDNQYNLVRTKGKNVIGVRLFDEADSAAERRGHRTNRRRLQRRRWRLRLLDDIFAKPLQAVDPNFLARLKYSYVNKKDQGQQDHYYGGYVFGSTAADQAYHQAYPTIYHLRKRLMEDDQKHDLREVYLAIHHIVKYRGNFLNPQSSLDIDQQFDVTDFAQALARFADHQALSWALEAPIRFLEAELATGLSNSARVDAAIEAFSFDTKVDRAAIKEMLKGLSGNQIDFTKLFVNVDSADWDQEERKQWKMKLSEEDFDEQALPILERLSQDETEFFLAIKRAYDGIALMRFLGDEQSLSSAMIKAYEDHRRDLTFLKTQVRTPQNRQALSEGYTNYLSVDDKKHKRGAKELAQLIEASDASEQDKATMLDRIANDQFAPKQRTKANGLIPYQLHLAELKKILAKQGQYYPFLLDTFAKQGQSVNKIEELVQFRVPYYVGPMVPKSETAGNAENHWVEKNDGQTKVSVTPWNFDQVFNRDRAAKSFIDRLTGTDTYLIGEPTLPRHSLTYETFTVLNELNNIRIDGKRLPVETKQAIVEDLFKKYRLVTKKRLQDYFASFGKREVELTGLADESRFTSSLTSYHDLQGLLGTDFITNPQNHSLLEKIVEIQTVFEDSDIAERELGKLGLEQKLIPRLAKKHYTGWGNLSRKLLDTSFIHDPERPEEPVSIMDLLYTTNKNFMEILHDSEYGVEEWLKSQNMIDDQKDIQMRIDELTTSPANKRGIKQAFNVLDDITQAMGEEPAYVYLEFAREKQASRRTVSRKKRLETLYKNAALKTEFKAIKEALAEESDDRMQDDRLYLYYAQLGRDMYTGQSISIDQLSSHYDIDHIVPRAFIKDDSLENKVLVNRTDNARKTDSATFTADVKAKAFPLWQQLKKLGLISAKKFRLLTRTGDFTEMERERFIARQLVETRQIIKNVAALIEGHFSQTQAVAIRAEVTGELRQLTQIKKDRDINDYHHAQDALLVATAGTYLHRHFPKRDARFIYNEFDYYTQHWLKNQGENRRRHPYSFVVGTMSKGNEDWTPDNLNYLRKVMQYKTMLMTRKPVGPEGALYKETLIAADPKKRLVGASKERQDPTIYGGYTKESSAYMSLVRAGGKNQLVKIPVRIANEIHSGQRKLDDYVQAKVKKFERILLPKISLGQLVEDEGQRFYLATNEMKHNAKQLWLDQKVVTTYKRLTAESPVEDFLTVFDALTSSATIHHFKFYQRDLELLRDNRAGFQDLAKATQLKVLKDVLYELHDNAGWRDPIKQYFKEIGLKVRMWTKLQKEGGIKLTDQAELIYQSPSGLFEKRRRVQDLL

SEQ ID NO: 810 - protein, 1312 aa, Artificial Sequence
  Cas9
MQNGFLGITVSSEQVGWAVTNPKYELERASRKDLWGVRLFDKAETAEDRRMFRTNRRLNQRKKNRIHYLRDIFHEEVNQKDPNFFQQLDESNFCEDDRTVEFNFDTNLYKNQFPTVYHLRKYLMETKDKPDIRLVYLAFSKFMKNRGHFLYKGNLGEVMDFENSMKGFCESLEKFNIDFPTLSDEQVKEVRDILCDHKIAKTVKKKNIITITKVKSKTAKAWIGLFCGCSVPVKVLFQDIDEEIVTDPEKISFEDASYDDYIANIEKGVGIYYEAIVSAKMLFDWSIMNEILGDHQLLSDAMIAEYNKHHDDLKRLQKIIKGTGSRELYQDIFINDVSGNYVCYVGHAKTMSSADQKQFYTFLKNRLKNVNGISSEDAEWIDTEIKNGTLLPKQTKRDNSVIPHQLQLREFELILDNMQEMYPFLKENREKLLKIFNFVIPYYVGPLKGVVRKGESTNWMVPKKDGVIHPWNFDEMVDKEASAECFISRMTGNCSYLFNEKVLPKNSLLYETFEVLNELNPLKINGEPISVELKQRIYEQLFLTGKKVTKKSLTKYLIKNGYDEDIELSGIDNEFHSNLKSHIDFEDYDNLSDEEVERIILRITVFEDKQLLKDYLNREFVKLSEDERKQICSLSYKGWGNLSEMLLNGITVTDSNGVEVSVMDMLWNTNLNLMQILSKKYGYKAEIERYNKEHEKNIYNREDLMDYLNIPPAQRRKVNQLITIVKSLKKRCGVPNKIFFKVSREHQDDPKRTSSRKEQLKYLYKSLKSEDEKHLMKELDELNGHELSNDKVYLYFLQKGRCIYSGKKLNLSRLRKSNYQNDIDYIYPLSAVNDRSMNNKVLTGIQENRADKYTYFPVDPEIQKKMKGFWMELVLQGFMSKEKYFRLSRENDFSENELVSFIEREISDNQQSGRMIASVLQYYFPESKIVFVKEKLISSFKRDFHLISSYGHNHLQAAKDAYITIVVGNVYHTKFTMDPAIYFKNHKRKDYDLNRLFLENISRDGQIAWESGPYGSIQTVRKEYAQNHIAVTKRVVEVKGGLFKQMPLKKGHGEYPLKTNDPRFGNIAQYGGYTNVTGSYFVLVESMEKGKKRISLEYVPVYLHERLEDDPGHKLLKEYLVDHRKLNHPKILLAKVRKNSLLKIDGFYYRLNGRSGNALILTNAVELIMDDWQTKTANKISGYMKRRAIDKKARVYQNEFHIQELEQLYDFYLDKLENGVYKNRKNNQAELIHNEKEQFMELKTEDQCVLLTEIKKLFVCSPMQADLTLIGGSKHTGMIAMSSNVTKADFSIIAEDPLGLRNKVIYSHMGEK

SEQ ID NO: 811 - protein, 1312 aa, Artificial Sequence
  Cas9
MQNGFLGITVSSEQVGWAVTNPKYELERASRKDLWGVRLFDKAETAEDRRMFRTNRRLNQRKKNRIHYLRDIFHEEVNQKDPNFFQQLDESNFCEDDRTVEFNFDTNLYKNQFPTVYHLRKYLMETKDKPDIRLVYLAFSKFMKNRGHFLYKGNLGEVMDFENSMKGFCESLEKFNIDFPTLSDEQVKEVRDILCDHKIAKTVKKKNIITITKVKSKTAKAWIGLFCGCSVPVKVLFQDIDEEIVTDPEKISFEDASYDDYIANIEKGVGIYYEAIVSAKMLFDWSILNEILGDHQLLSDAMIAEYNKHHDDLKRLQKIIKGTGSRELYQDIFINDVSGNYVCYVGHAKTMSSADQKQFYTFLKNRLKNVNGISSEDAEWIDTEIKNGTLLPKQTKRDNSVIPHQLQLREFELILDNMQEMYPFLKENREKLLKIFNFVIPYYVGPLKGVVRKGESTNWMVPKKDGVIHPWNFDEMVDKEASAECFISRMTGNCSYLFNEKVLPKNSLLYETFEVLNELNPLKINGESISVELKQRIYEQLFLTGKKVTKKSLTKYLIKNGYDKDIELSGIDNEFHSNLKSHIDFEDYDNLSDEEVEQIILRITVFEDKQLLKDYLNREFVKLSEDERKQICSLSYKGWGNLSEMLLNGITVTDSNGVEVSVMDMLWNTNLNLMQILSKKYGYKAEIEHYNKEHEKTIYNREDLMDYLNIPPAQRRKVNQLITIVKSLKKTYGVPNKIFFKVSREHQDDPKRTSSRKEQLKYLYKSLKSEDEKHLMKELDELNGHELSNDKVYLYFLQKGRCIYSGKKLNLSRLRKSNYQNDIDYIYPLSAVNDRSMNNKVLTGIQENRADKYTYFPVDPEIQKKMKGFWMELVLQGFMSKEKYFRLSRENDFSENELVSFIEREISDNQQSGRMIASVLQYYFPESKIVFVKEKLISSFKRDFHLISSYGHNHLQAAKDAYITIVVGNVYHAKFTMDPAIYFKNHKRKDYDLNRLFLENISRDGQIAWESGPYGSIQTVRKEYAQNHIAVTKRVVEVKGGLFKQMPLKKGHGEYPLKTNDPRFGNIAQYGGYTNVTGSYFVLVESMEKGKKRISLEYVPVYLHERLEDDPGHKLLKEYLVDHRKLNHPKILLAKVRKNSLLKIDGFYYRLNGRSGNALILTNAVELIMDDWQTKTANKISGYMKRRAIDKKARVYQNEFHIQELEQLYDFYLDKLENGVYKNRKNNQAELIHNEKEQFMELKTEDQCVLLTEIKKLFVCSPMQADLTLIGGSKHTGMIAMSSNVTKADFAVIAEDPLGLRNKVIYSHMGEK

SEQ ID NO: 812 - protein, 1313 aa, Artificial Sequence
  Cas9
MHYLDEIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIMKYRGHFLNNASVDKFKVGRIDFYKSFNVLNEAYEELQNGEGSFTIEPSKVEKIGQLLLDTKMRKLNRQKAVAKLLEVKVADKEETKRNKQIATAMSKLVLGYKADFATVAMANGNEWKIDLSSETSEDEIEKFREELSDAQNDILTEITSLFSQIMLNEIVPNGMSISESMMDRYWTHERQLAEVKEYLATQPASARKEFDQVYNKYIGQAPKERGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKVSDVASLVMAKTRGVNKPSVEGLSDPKKFNSNLATYLDLKSIVGDKVDDNRYQTDLENIIEWRSVFEDGEIFADKLTEVEWLTDQQRSALVKKRYKGWGRLSKKLLTGIVDENGQRIIDLMWNTDQNFMQIVNQPVFKEQIDQLNQKAITNDGMTLREWVESVLDGAYTSPQNKKAIWQVVRVVEDIVKAVGNAPKSISIEFARNEGNKGEITRSRRTQLQKLFEDQAHELVKDTSLTEELEKAPDLSDRYYLYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKKRPVDLYGAYTNGTSAFMTIIKFTGNKPKYKVIGVPTTSAVGLKRVGKPGSESYNQELHRIIKSNPKVKKDFEIVVPHVSYSQLIVDDDCKFTLASDTYQHPATQLVLSKESMEIIADDFKFVKENTATADEQLVRVFDEIVNQMNHYFTIFDQRSNRQKVTKARDKFVSLPTESEYEGAKKTQVGKTEVITNLLMGLHANSAQGDLKVLGLSTFGFFQSSGGLNLSEDAMIVYQSPTGLFERRICLKDI

SEQ ID NO: 813 - protein, 1313 aa, Artificial Sequence
  Cas9
MSFKENSKIYYGLDIGTDSVGWSTTNEKYELLRYKNNLMWGVSLFEAASLAEERRGHRTQRRRYDRRQQRVALLGELFAKEILKTDPDFFLRLKESSLYPEDRTSKNVNTYFDDADFKDSDYFKMYPTVHHLIKELSESNKPHDVRLVYLACAFIVAHRGHFLNGADENNVQAVLDFDSSYCEFTDWFKSNDIEDNPFSESVKNEFSVILRKKIGITAKEREIKNLLFGTTKTPDCYKDEEYPIDIDVLIKFISGGKTNLAKLFRNPSYDELDIQTVEVGKADFADTIDLLASSMEDTDVPLLSAVKAMYDWSLLIDVLKGQKTISDAKVCEYEQHKSDLKALKYIVRKYLDRAQYDEIFRTAGEKPNYVSYSYNVTDVKLKQLPSNFKKKNSEEFCKYIKSKLEKIKPESDDEAVYNELIEKCNSKTLCPKQVTDENRVIPYQLYYHELSMILDKASAYLDFLNKTEDGISVKQKILTLMKFRIPYFVGPLVKRNETDNVWIVRKAEGRIYPWNFENMVDFDKSEDGFIRRMTCKCTYLAGEDVLPKYSLLYSKYTVLNEINNIKVNGEKISPELKQDIFNELFMKTSRVTVKKITELLKRKGAFSEEKGDSLSGVDINIKSSLKSYLDFRRLLENGSLSENDVERIIERITVTTDKPRLVSWLKAEYSDLPAEDIRYISRLSYKDYGRLSAKLLTGCYELDTNTGEIGGRSIIDFMWAENINLMQILSDSYGYKSFIEEENKKYYMINPTGSIAQTLREMYVSPSVSRAIIRTMEIVKELRKITKKDPDKIFVEMARGGKPEEKGKRTSSRREQIEKLYDSAKAFVSDEDISHMRSQLGSLSDEQLRREKYYLYFIQFGKCMYSGEAIDFSRLGDNHCYDIDHIFPQSKINDDSLHNKVLVKSQLNGEKSDDYPIKAEIRNKMHPLWKNLFYRDPKNPADKVKYERLTRSTPFTEDELAGFIERQLVETRQSTKAVATLLKEMFPDSKIVYVKAGQVSEFRHDFDMLKCREINDLHHAKDAYLNIVIGNVHDVKFTSNPMNFVKNADKHYTIKVKETLKHKVSRNGETAWNPETDFDTVKRMMSKNSVRYVRYCYKRKGGFFNQNPDRAGNPDLARLKKDLDPVKYGGYNSKSISCFSLIKCTGVGAVIIPVELLCEKRYFSDDSFASEYAYSVLKNALPAKNIAKISIDDISFPLKRRPIKINTLFEFDGYRVNIRSKDSYHYFTISSAMAAIYSKDTSDYIKAVSSYIDKSDKGSKFKPGEAFDVLSNLKVYDEIAKKCISEPFSKISKLAEAGKRWKKEEISLQNCLL

SEQ ID NO: 814 - protein, 1314 aa, Artificial Sequence
  Cas9
MLKKDYSIGLDIGTNSVGHAVVTDDYKVPTKKMKVFGDTSKKTIKKNMLGVLLFNEGQTAADTRLKRGARRRYTRRKNRLRYLQEIFAPALAKVDPNFFYRLEESSLVAEDKKYDVYPIFGKREEELLYHDTHKTIYHLRSELANNDRPADLRLVYLALAHIIKYRGNFLLEGEIDLRTTDINKVFAEFSETLNENSDENLGKLDVADIFKDNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKRMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDTYSFKETIKNAQVIEKEETLAKTVQELPGSPAIKKGILQSLEIVDEIIKVMGYKPKSIVVEMARETQKTHGTRKREDRVQQIVKNLKDANELPKKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAVVANLIMAKYPELEPEFVYGKYRKTKFKGLGKATAKNTLYANVLYFLKENEVYPFWDKARDLPTIKRYLYRAQVNKVRKAERQTGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 815 - protein, 1315 aa, Artificial Sequence
  Cas9
MGYSVGLDIGTGSVGWVVTNEDGKLARAKGKNLIGVRLFKTAEPAADRRTNRTTRRRLSRRKWRLRLLDELFANELGKIDSNFLTRLKYSYVHPKDDANRANYYGGYLFPTQEETKKFHAKYPTIYHLRLALMTESRQFDLREIYLAMHQIVKYRGHFLNSQSKMTIGNTYNPQDLQTAMENYAEAKGLSIELKQPEEMVAILTGEAGFGLSKKAKAEKLLNNFFFDTKEEKATVQAILAGIVGNTIDFTKVFNRQLTGDTLKAWKLKLDSETFDVDSEPILSDLDDDETELFFAIRQAFDGFTLMNLLGDQTSISAAMVERYTQHHDDLLTVKQVAKKQGLSHKEFSNIYSAFLKDDTDKGMKKLLEESNLSTEDVNGIQLRMDSHDFLPQQRTKANSVIPHQLHLAELEAIIENQGQYYPFLLETFEKEGTAANKIAELLKFRIPYYVGPMVTKKDVENAGGDATNHWVTRNEGYEKSAVTAWNFDQVFNRDQAALDFIQRLTGTDTYLIGEPTLPQNSLKYQMFTVLNELNNVKVNGRRIDNQTKHDLIQDLFKSKKTVSLKAFQDYYQSQGKSDIQVVGLADKTKFNSNLSTYIDLSKTFSAEEMENPQNQDLLEQIVEIQTVFEDSKIAERELSKLELTPEQVTKLAKTHYTGWGNLSNKLLTTPIVDVSGKKVSILDQLAKTSKNFMSIISNEQYGVQDWIKEQNTTETTGTLEDKLADLTTSPANKRGIKQAFNVLFDIQKAMKSEPDRVYLEFARETQTSVRTMSRYNYLKGLYQSKSLDAEAKNLKKELAETDQKKFDNDRLYLYFQQQGKDMYTGQPINIDKLSSDYDIDHIIPQAFTKDDSIDNRVLVSRPENARKSDSGTYTTEVQAAASGLWKTLVQSGFISRKKYDRLTHAGDYSEGQKTGFIARQLVETRQIIKNVAALIESEFDQTQAVAIRAEITGDMRRLVAIKKHREINSFHHAFDALLITAAGQYMQKRYPDRDSNNVYNEFDRYTNDYLKKLRESSSKDEVRKLKPFGFIVGTMAKGNEDWTTEQTEYLRHIMNFKNILTTYKTGPDRGPLSKETIYAVDPKAKLIGTNKHRQDVSLYGGYTYPYSAYMTLVRANGKNQLVKVSRSAASLMKSGQLKLEDYVQQQPEVKKFEKILLEHLPLGQLVDNDGKLMYLTSYEFYHNAKQLWLSTENADLISSLSIDSDDQKLIKAFDILTADSVIERFPFYEIDLKKLIELRDKFVLIDNKLDVLRVVLKALQLDSAQQKPLKLIDKAATDWKNYRQAGGIKLSDNAEIIYQSTTGIFEKRIKISDLL

SEQ ID NO: 816 - protein, 1316 aa, Artificial Sequence
  Cas9
MLQKNYTIGLDIGTNSVGYAVINDNYKVPAKKMKVLGNTDKKTIKKNLMGVLLFDAGETAATTRLKRGTRRRYTRRRNRLRYLQEILGPELAKVDANFLHRLAESSLVTEDKEFSAYPIFGDREEELLYHKTYKTIYHLRSALANKDEKADLRLIYLALAHIIKYRGNFLIEGEIELSDTDIDKVYADFCRSFNELFDTEVLQEIEVEAIFKDKTLSKTKKAEELVKVSGVKKNQVAHQFLKMMVGNTVNFKKVFNLTEDQKLSFGTDSYEDELNDLLAKSDDRYLDVFVAAKKVYDTAILANILNTKNSVATKTIFSQSMIERFKDHQKDLKELKQLFKTYLPEKYPDFFGNSKEDGYAGYIEGKTNEEKFYTHTKKILKNIPQAASVLAQIDVGNYLRKQRTFDNGVIPHQIQLKELLAIIENQGKYYPFLLENKEKIAKILTFRIPYYVGPLARGNSRFAWLKRVGKEKITPFNFENVVDLESSAERFIERMTLNDLYLPEEKVLPKHSMLYEKFSIFNELAGIRYITDNGEMKFLDAQTKQSIFELFKQERTVKEKKVLDLLKTLMPSERVVAIKGIDNGKFNASFGTYHDLSKMGFKTEKIASESNQARWEEIIKTLTIFEDRKLIKSRLRKYDDFLNEKEIGALSKRKYTGWGRLSAKLIDGIYDKKTHQTILDFLMNEDYNQNFMQLISNDNYSFKKIIEDSQVIKEEGSLTEVIQELPGSPAIKKGILQSIEIVDELVKVMGGNPKKIVVEMARETQKTHGTTRREARIKEIIKNLNKLKLNELPKDLPSNEELSDEKVYLYCLQNGRDMYTGAPLDLDNLSQYEVDHIIPQSFLKDDSIENKVLTAKIENSRKTNGLPSVEIAKKMGAFWRSLLKVGAISEKKYRNLRRSLHGGMTEKLKETFVKRQLVETRQITKYVAQILNSRFNEEKNEDKVAIVTLKAQLTSQFRKDFELYKVREINNLHHAHDAYLNAVLATLLMTSFPELEPEFVYGKYRKTKFKGLGKATAKNNLYTNILQLLKEESAQYWDTKERDLATIKKNVYQAQVNKVRKVERQTGSFYDETVAKKSASQKLFPRKNGLDPVKYGGYQRANEGYSLLFRADMLNKRGKTKSVKTLVKIPIIESAQYLADPTEYLAKRGYYNVSEHSLLLPKFSLLENNNGLRRYLASSNEFQKANELILPKHLVRLLYWSQSKQRKEELNKHRAEFAELFTYIMDFADKYVVAPKNSEKIKNIYENNKDSSVEVLGKNFIELLKYTADGAASDFTFFDTKIPRKRYNSAGDLLDGTLIYQSKTGLYETRIDLGAI

SEQ ID NO: 817 - protein, 1318 aa, Artificial Sequence
  Cas9
MMIKLNNMKKILGLDLGTNSIGWAVVETEDNKKFELLDKGVRIFQEGVKIEKGIESSKAAERTGYRSARRIKFRRRLRKIETLKVLIENNMCPLSMDELIVWKENKNNYPKNKIFYNWLKTKDPKEGTNGTYINPYYFRTEAIKRKLENTNDVGRALYHLAQRRGFKSNRLESTDEKSRGIVKTEINKLSSELNGRYLGEYFYELYLKGEKIRKRHISREEHYLNEFKKICEVQNFNKELAEKLERAIFYQRPLKSQKGLVGKCTLQNNKHRCPISRPEFEEFRMWQFINSIKYKNSDGKFDFLNKEQRENIIPAFVSNKNATFEFSKIEKILNKGVHIYQFNYKSNHTIGSNQTMINFMDVFDIDRKLTNAWLLCVNKIYELYTAKTKKDGSLKSKSEVITDVWHVLFTFDNEENLKEFARNKLLLDESSAQKFSKINLKQDYSQLSLKAINKILPYLQEGLIYSYAVFIANIENVIGKSIWNIKENQQIIRTSIKKIIDNHKTELDINTITNSLINDFKVNYNNAHKEYKVDDIDLKNIREKIIKYYGNKTWNCLPEDEKLYVKEKVEKLYEKQLKSGKRGIFIEKIRLDDRIENFLKDNFDSSELNLKKLYHPSDVSVYKSVKITDLGLRLLGSPMIPSIKNPMAMRAMHQLRKLINHLIIEGVIDDSTIINVEMSRELNDANMRKAIERYQRQRATENEEFKTKIKELYKKECGTDFEPNNDDIMKYRLWEEQNHKCLYTGKSIGICDFIGSNPAFEIEHTIPRSLSYDNSLENKTLCEKEFNQQVKKNRIPFELSNYKEIISRINNWEIKAEELFKQIQKVKIQSRMAATKEIKDNAIQRKHLLQMEFNYWNGKLSRFTREDVPEGFKNSQLVDIGIITKYARAYLKTVFNNVNTVKGSTVAEFRNIWGLQEYFEKKDRSNHIHHCIDAITIACLTKDKYDFLAHLYHLDEQNNRDAVHRAMIKSKPWENFVQDVKEIENQILVSHYTPDNLPKQSKKILRKRGKIQKNENGDLIYEKGDAVRGSLHKESFYGAIKREIINKKGETEEKVLYVKRKPLEFSDLGFKTISELENIVDDAVRDKVLNAVKDKGLKQALNEPIWMNEEKQIPIKKVRCYTPSVTNPINLKKHRDKSKHEYKQSYHVTNDGNYLMVIYEGKDSQEKVKRDYEIVSNLQAGEYFKQSVHGVLKAQGINNLEGLIPKFKESGKNILPLKYILKTGTMVIFWENYPEEIWDIDKNQLYKRLFKVTQFESDGRIQARFHQIAKPDNELTKVSELDFSNIAEKIRLSKGNLNMLVNGYDFKINVLGHIEKLS

SEQ ID NO: 818 - protein, 1318 aa, Artificial Sequence
  Cas9
MGSNMLKKDYSIGLDIGTNSVGHAVVTDDYKVPTKKMKVFGDTSKKTIKKNMLGVLLFNEGQTAADTRLKRGTRRRYTRRKNRLRYLQEIFAPELAKVDPNFLYRLEESSLVAEDKKYDVYPIFGKREEELLYHDTYKTIYHLRSALANNDQPADLRLVYLALAHIIKYRGNFLLEGEIDLRTTDINKVFAEFSETLNENSDENLGKLDVADIFKNNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKHMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDNYSFKETIKNAQVIEKEETLAKTVQELPGSPAIKKGILQSLEIVDEIIKVMGYKPKSIVVEMARETQKTHGTRKREDRVQQIVENLKDANELPEKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAIVANLIMAKYPELEPEFVYGKYRKAKFKGLGKATAKNTLYANVLYFLKENEVYPFWDKARDLPTIKRYLYRAQVNKVRKAERQIGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 819 - protein, 1319 aa, Artificial Sequence
  Cas9
MFSQRNNPYCELLFKIIVTNIEEKNLEVIMGIRNSDIFFISNFMWYQKLIMMIKNILGLDLGTNSIGWALIEVDENNIPIRIIAMGSRIIPLSTSDKEEFQRGLSITKNQNRTVSRTQRKGYDRKQLRRSDLKKILKKYNIFPSEELLKLPMLDLWKLRSDSANPNEDISAEQLGRILYMLNQKRGYKSARSEANSDKKDTDYVQAVKGRYAQLKDRRQTIGQYFYEELSTAFSDKNNQQYFRVKEEVYPREAYIEEFDTIINAQKDKHGFLTDKVIHQLRNEIIYFQRKLKSQKGLVSICELEGFEKTVYDKEKNKNKVVFVGPKVAPKTSPLFQLCRIWEVVNTISLKIKNPEGSKYKWGEKVPNLKQKEILADYLFKNENLSFSTLLEILELKKEDVYVNKQILKGIKGNEAYAALHNVLGDHELLNFDVSIITSDHTAILVDKKTGEILEERAGLELDASLEREPLYQFWHTIYSLKDLDECKNALIKRFGLDEDIAEKLSHIDFNKQAFGSKSNKSMRKILPFLMEGYNYSESCSLAGYNHSNSLTKDERESQITLERLELLPKNNLRQPIVEKILNQMINVVNTILEKYGKPSEIRVELARELKQSKDERNDTDLQNSRNKKLNEEIGKRLAELGLPVTKRYIQKYKFIFPSLSKNLKDAHVNNQCIYCGETFNLTEALNGDAYDVDHIVPKALLFDDSQTNKVLVHRKCNSTKTNQTAYDYITAKGEEEVRIYSERVDDWFKKGIISYSKMQRLKVSHKEYLERKKLGKETETDKKLWENFIDRQLRDTQYISRKSREILQKVCNNVTTTEGGVTAKLRNLWGWDDILMNLQMPKYKELGQTITKEWTSEHGKRKHQKEEIENWTKRDDHRHHAIDALVVACTKQGFIQRINTLNSSETKDLMIKEVEEAKIEFNEKTTLLEKYLKTQKPFTTREVMKEADKILISFKAGKKVATITKFKATGKNKETGVIVPRGALHEQSVYGKIKVIEKDKPLKYLFENPDKIVNSRIRDLVETRLSENENNSKKALSTVKKNPIFFNEEKNEILEKASCYNDATVLKYKLQNLKANQVDDIVDERVKFLVKERLTQFGSKEKEAFKDILWFNQEKQIPIITVRLFARPDANNLQIIKKDKNGKDIGFVLTGNNHHIAIYEDKDSKLVQHSCAFWHAVERKKYNIPAVIKNSADVWSLLLDKELPVLFLDKLPADELNLKFSMQQNEMFILGLSQEGFDEAIKNNDKSLLSKHLYLVWSISNNDYYFRHHLETKNTELKNIPTAKDSKRYFRFKSVGALVGINPIKVRLNHLGEITKIGE

SEQ ID NO: 820 - protein, 1319 aa, Artificial Sequence
  Cas9
MGYNIGLDIGTGSVGWAALTDEGKLARAKGKNLIGVRLFDSAQSAAQRRSYRTTRRRLSRRKWRLRLLENIFSDEMGMIDENFFARLKYSYVHPKDEVNNAHYYGGYLFPTQQETHDFHEKFQTIYHLRLKLMIEDCKFDLREIYLAMHHIVKYRGHFLNSQSKMTIGDSYNPRDFQQAIQNYAEAKGLIWSLNDAQEMTDVLVGQAGFGLSKKAKAERLLSAFSFDTKEDKKAIQAILAGIVGNTTDFTKIFNRERSGDELKKWKLKLDSEAFDEQSQAIVDELDDDEMELFNAIRQAFDGFTLMDLLGDQTSISAAMVKRYQQHHDDLKMVKEIAKKQGLSHQDFSKIYTAFLKDDTDKGMKALLDKADLADDVLVEIQQRIESHDFLPKQRTKANSVIPYQLHLAELEKIIENQGKYYPFLLDTFTNKAGETINKLVELVKFRVPYYVGPMVTAADVEKAGGDATNHWVKRNEGYEKSPVTPWNFDQVFNRDQAAQDFIDRLTGTDTYLIGEPTLLKNSLKYQLFTVLNELNNVKINGHKIDEKTKHVLIQDLFKSKKTVSEKAIKDYYLSQGMGEIQIVGLADKTKFNSNLSSYIDLSKTFDAEFMENPANQELLENIIQIQTVFEDVKIAERELQKLALPDEQVQQLAKTHYTGWGNLSDKLLSTPIIQEGSQKVSILNKLQTTSKNFMSIITDNKFGVQQWIQEQNTAETADSIQDRIDELTTAPANKRGIKQAFNVLFDIQKAMGEEPNRVYLEFAKETQNSVRTNSRYNRLKDLYKSKTLSDDVKALKEELESQKSSLQSERIGDRLYLYFLQQGKDMYTGQPINIDKLSTDYDIDHIIPQAYTKDDSIDNRVLVSRPENARKSDSATYTTEVQQSAGGLWKSLKNAGFISQKKYDRLTKGGDYSKGQKTGFIARQLVETRQIIKNVASLIESEFSQTKAVAIRSEITADMRRLVAIKKHREINSFHHAFDALLITAAGQYMQARYPDRDGANVYNEFDYYTNTYLKELRQSSSSSQVRRLKPFGFVVGTMAKGNENWSEDDTQYLRHVMNFKNILTTRRNDKDNGALNKETIYAVDPKAKLIGTNKKRQDVSLYGGYIYPYSAYMTLVRANGKNLLVKVTISAAEKIKSGQIELSEYVQQRPEVKKFEKILINKLAIGQLVNNDGNLIYLTSYEFYHNAKQLWLPTEEADLISQLNKDSSDEDLIKGFDILTSPAILKRFPFYELDLKKLVNIRDKFIAVENKFDILMVILKALQLDAAQQKPVKMIDKKSADWKDYRQRGGIKLSDTSEIIYQSTTGIFEKRVKISNLL

SEQ ID NO: 821 - protein, 1320 aa, Artificial Sequence
  Cas9
MTEQQRPYNIGLDIGTSSIGWAVTDQNDKLLHIRGHNGIGVRLFKEGESAAERRGFRTTRRRLSRRRWRLRFLDRIFDAELAKVDPNFLARLKQSNISPLDPNKQMFGNILFDDAQFDDQKFHQQYPTIYHLRSALAQPDAPQADVRLIYLALHHMIKFRGHFLNGAAVEKFHGGQLHLEAEFQELNQIFSNQQRDHVQLQTSSLDEVATILKDNQRTPSDRQRELSARLFVPVDKTIDKENKKLATELLKAVLGLKAKFDVILGVEATDPQAFKLQFSSDDFDDKIAELASELTDEANEILTVLQRLYFSLNLADILTNRQTKQVADSISTAMINRYDDHKHHLKMLKELETQVTQEQRDGLKKAYDEYIDGDKPTIDTFYTNVKKNLDDSELANQIKSLIDLQAFMPKQRSKENGSIPHQLHQRELDQLIEVQGKYYPWLLAAKDKLDALIAFRVPYYVGPMIDPNESDDPQNTKFAWMVRKEAGEITPWNFEEKVDKTGSATNFIKRMTTTDTYLLGEPVLPKNSLLYQQFTVLNELNKLKVDGKALTVDQKKYLYEHVCKKQRRVTLKKLSDCLMARGDFPMGAIFTGTTDQKNMNNTLKTYQDFQEIFGDEIDNPDRQVDFEKMIEWSTIFEDREIFKLKLAELNWLTSEQLERVSKKRYQGWGRLSQKLLTHIVNENGERIIDQLWNTNQNFMEIMGQDGVKQAIQEHNGANVAQTGINETIDELYTSPQNKKAIRQILLVVDDIKKAVGYAPANIMMEFAREDRDDHRLIASRARQLEKTYQEISKNWFDNESVTQELKDQIKNKTKFTDRLYLYFIQGGIDLYTGHPLNIDQLSSYDIDHILPQSFLLDNSLNNRVLTSQSENRVHKEDRLPGETVANKMRPTWKMMREQGLMTQRKYNNLTLKPDQISKFNNRGQFINRQLVETRQVIKLAADIMNQKYQADQTKVVTVKANLTHHMREKFNFYKSRNVNDYHHAFDAYLTVFVGNWLLKEYPKLQPYFVYGDFAKTGTNNLKSFNFLYRFERDHKLNDKGAIDTDKDQQLGYMKRIYRFKKMLVTKQLETNEGALYKQTIYKAPANEKNTKKNRSLINTKKNRPSDIYGGYSQSVTAYMSLVFFKNTFKLIKMPLVAANAIKNSLSSYHDTILKILGSNEFKVLIPKVKMNQLIKEGDSLYTVVGVYKHNAQQLILSDNSMGIITKPIREICDSDLDSVFNELVDNIDKYLNLYKIEDKLTIKEKFYALKNKESKFKCISDILVGTHCNAGRSNLKIIGLSSYWGMFSGNNDGLKINENSQLIYQSPTGLFEHRVKVSDL

SEQ ID NO: 822 - protein, 1323 aa, Artificial Sequence
  Cas9
MKDFYIGLDMGTDSVGWAVADEDYNLCKFKGKAMWGVRLFDESATAAERRGFRTARRRAQRKRQRILWLQMLFNEEISKKDIAFFQRLNESKLYLEDKSTNVPYAVFADESFTDVDYHKLYPTIYHLRKELVQSDEPHDVRLVYLALHHLIKNRGHFLFENVGSDFEKESSFEVLFKNLQNYILGEYELALECISPLQIADILKDKSKRKTTKSSEICKLLGISKKGQPRLNAIVLLMCGQSVKLADLYGDENYNKEEKSSISFEKGYEDNEETYRELLLERFELIEKIKALYDWAILADILKGETYISFAKVKTYDEHRHDLQQLKAFVKERCRSDYNEIFRETSDKLNNYTAYCGKFKENGRNGVILHSANQTDFCKYLKSKFDKLDKSGYEDMFEKIENGSFMPKIVVKDNGVIPMQVNESEVRAILKNASGYLDFLNNQDKDGITVADKILQIFEFRIPYYVGPLNVHSDNSWLVRKDGKIYPWNFNKIVDVDKSAEEFINKLTAKCTYLPDRDVIPKNSILYSRYMVLNELNNLKLDGKKPDVSFKQAVFNDLFMHRRKVTQKALREYIKAQTGTEPEITGIDGDFKANMRPAIELAGYNLSEPDKEEIIKAITIFGDDKKLLKRRIKDKYSEMLSEDEIKKICKLKYKDWGRLSREFLTEIFDVDTATGECKDNIINTLWNTNDNLMELLGAKYNFTQSIEQAISKSTHKASIEKMVEDMYVSPKVKRTVFQSLKIMKEIVKIKGHAPKKVFVEMTRHDGTKGDNGRTKSRKKQLEELYKKCKEDSTELWDELEKTDDDEFRQDKLFLYYTQMGRCMYSGERIELRDLFNKNLYDIDHIFPRSKVKDDSIDNRVLVKKQINSHKDNDYPLDSTVREKMRGHWQYLLRHGFISKKKYDRLTRVTPLTDDELADFIARQLVETSQSTKAVATLLKTLYPTTEIVYVKAELVSRFRTEYKFIKCREVNDLHHAKDAYLNIVVGNVYNVRYTHSKAIFIKGLQTKKYSLNRMFAFDTPGAWNIENEKSLSIVKKTVMKNNILYTRYSYMKKGGLFKIQPLKKGNGQAPLKKDLPLSDIGKYGGYDKPTASYFSYIKYEGKKGKECRQLVAIDNYLKKYYEENPIEYLTNRLGLKNPAVLIPVIKYNSCIEIDGFRMNISSKSNEGKTIVYKPAVQLVLGAEKEAYVKKISKVLSKPEEQKITSYDGVSAEENIELFDALTAKMTNTIFKIKLEDIGNKIKSGRDKFVTLDVKKQCYVINEILKIMHCNVVTGDLSLIGAAKKAGIVSTNSALSEIKKVSSIMLINQSVTGLFETKIDLLNI

SEQ ID NO: 823 - protein, 1324 aa, Artificial Sequence
  Cas9
MRAKGKTLIGTSLFREGNTAAERRGYRTTQRRLKRRKRRLKLLEAFFDPYIFEVDENFLARLHEADISPKDENKRFWGSLLFPNEKDANFYRKYPTIYHLRKALMEEDRKFDVRAIFLAIHHIMKYRGNFLSPLSVDSFKQEGLELKEQLDRQLKRVAELYNELNTDVKINVSDVETIQDIIIDKNKSRRDKAGALKKLLAVSSDRKEINKLNASLAKELSNAILGMKAQFANLLLADDLEIDKNKKNFSLLDTNAEENVSGLLELVNEKQAELFDAIKTIHDQIILNEIVPDGKSISQSMVDKYEAHREQLQVLKALYEKMDAKQIKAIKKAYSLYIDGKDPKAKKVDKRAHQNRADFYKEVKKVLVELDDSRAEKLLGLIEMGQFLPKQRTAMNGVIPNQLHQVELDKIIEMQSKYYPWLAEKNPVKSHQKRAPYKLDELLTFRVPYYVGPMVTSKKQQQTSNSNFAWMVRKQEGEITPWNFEEKVDTIASANDFIKRMTAKDTYLVGEDVLPANSLLYQRYKVLNELNNIKVNGRRLPVELKREAYVALFENGDSKTVSAKCFKNWLNVKLKNLNSLKLEGLSTGTKFDNNLSTYHDLKKIFGKAVDDAGRQKDFEQIIEWLTIFEDKKILRIKLKEIEWLTEENITQLTRLNYNGWGRLSRRLLTGICDSNGQRIMDWLWDTTNNFMQIQSQPDFQKAIVEYNSDKLEQGDIEQILGEAYTSPQNKKAIRKVIKVVQDVEKAMGAKPTSISIEFTRSDGRSELTNSRMTQLQKTLMSLSEEMTDQALLAEFKDFQASKKKLTNKYYLYFTQLGRDMYTGEPLNIDQLSLYSDGDHILPRSFIKDDSLDNRVLTKRAVNNEKSDTVPVCEYGAKMKDFWNDLYDNGLISKQKLANLLTDPDEIGPYKANGFIRRQLVETSQVIKLSAEILQTLYQDTKIIEVRQKYTHELREHFNFVKIRQLNDYHHAFDAYLTAFSGRYLYQRYPKLRGYFVYGDYNKFDAKKDRNYLKSYNFLYDLEEGKTDQIVDNVEHKVFMNRQDAINQLKKAYEYKYMLVSQETYTNSGAMFKETIYPVNPKQKLIQKKNDKPVDIYGGYSNNYDAYLSIVRLEDKKGIKFRVVGIPMRNKAELDNLAKEDHNGYMQRLNEIVDEQINSSGKKKTFRIILPKVHFKQLVEDDSGKFMLGSAAYPYNAKQLVLSVKSIESLANKDASDRELVAVYEEILNVVNDKFTLYDARQFRNKLTSSKDKFVELNTADKVTELLDILDGLHANPVVKKLKIISGSPFGFLQRPSGIVLTENAKLIYQSPTGIFERVVYLRDL

SEQ ID NO: 824 - protein, 1327 aa, Artificial Sequence
  Cas9
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 825 - protein, 1327 aa, Artificial Sequence
  Cas9
MKNYSIGLDIGTGSVGWVCIDENYQILRYNNRAAFGVHEFETAHVAEERRIKRGARRRYNRRKKRIQLLQSLFVPHMQQKAFFAPTITEHYWKNDNQFENRTLSEVLMSLGMNPNTYPTIFHLRHELIESSVKKDARLIYLALHNLVKFRGHFLQEGSTWNANMSDANLSEQFEQLLHIYTEMEELPQVSLTAQQSTDVEHILLNNHISKAERARQLTALFERTYEPFFKLIVGLDIAAAQLFKQSEQQLLYKESKTKVNLTAETLPEVLQTMLEPEVAFIEAVQPFYQQTVLFDLLKGQSYVAAAKVEAFNQYERDLALLKSVINEVGSEKQYRAFFITSKQKKRQFEQKPNMELLCHLDRFNREKKYEETFYKEVSKLLTALIKEATGEVKEHIEQIIQAMESQSFLVKQKGIQNASIPYQNSLYEAEMILRNQQAYYPWITDEFIEKVKQLIAFRIPYYIGPLVQGDEQPFGWLQRQADGNITPWNFDEKVNKAASAESFITRMTKNCTYLKEEKVLPKQSLMYEKFTLLNELNSVQIRSSLEQPHKKHRLCEDMKQWIIEHVFKKTKTVTHKTLIQALKKSPYKDELYDESTGNWKDVYGTQKEDRFASSLSTYISLKEIVGDIVDNAFMEEIIYWLTVFTDRDIITLKMNDKYPFITEQQIQRLLSLNISGWGQLSQRLLQSIPVDDMNRSVIEYMEKHAVNFMELLSPRQSDLAYKIEQVNKQHSKKIHKIRYEDIEQLTGSPALKRGIWRSVKIIEELTAIFGEPKNIMIEVAREDQASHRTKSRKEQWESIGKSLAKEEKELKAFFKEMAQYPKQQFDRTRFWLYVTQQGKCLYTGKTLRLEDLSSYEIDHILPRNFVKDDSIDNLALVYPMANQEKNKAGNNKMPLEIIDAKQQPAMMAHWKRLNQLKLISDSKLHKLMKPSFNDVDKENFIARQLVETRQIIKHVRDLLQERFEHTDIHVVKAKMVSQFRKFSRIPKIRDYNNKHHAMDALFTTVLIQFILQKYGKNFLQFDLQHKDISKKWSKIAQSTKHFFLFQQFAEQQIKSPVTKELVSGVQYFEHIFYEQSWQTTKMTQTIDSNFYKETIFSPKLKTAKYTSAKAEKFVHDAIVKYAVCGIQYTSLKKNKEQHHVLLTDINVIEHYQLKEASLNELALHLAKRESKDDVIDAQMLVVIPKYKKIMLNGSPYYCISSDERHIATQFVLRKDLLEAVLHVNDETSVDELRTLFRSIVEEMMTQYKVYNKDTIRNKIDAFIETELIDVETFQVGFTEIKKMVAANAQRSDKFGGRLRQVMKVEDIYIIDESITGLRYRKPRKLVK

SEQ ID NO: 826 - protein, 1327 aa, Artificial Sequence
  Cas9
MKKNYTIGLDIGTASVGWAVLTEDYELIKRKMKISGNTQKKAVKKNFWGVRLFEQGETAEGRRLKRTTRRRIARRRQRIQYLRTIFDEGMNQVDANFFARLDESFSIIDEKENERHPIFGNVAEEAAYHEQFPTIYHLREHLANSSEQADLRLVYLALAHIIKFRGHFLIEGELNTENSSVSGTFEQFIKVYNETFNVEKALDLTVDLDGIAEQKISRMKRAELILSLFPEEKSTGDFAQFIKMIVGNQGNVKKTFSLNEDAKIQFSKEEYEENLETLLAEIGEDFRSVFDAAKSVYDAISLANILKVTDATTRAKLSSSMVVRFTDHKEDLKTLKRFVRENLPDEYDDLFKNKKVAGYAGYIDGNETQEAFYKYLKKTLAKATGAEGFLAKMEQEDFLRKQRTFDNGVIPYQLHLEELKAIIKNQKSYYSFLDEEKISQLMTFRIPYYVGPLAKEKGQFAWLTRKEMGKITPWNLNEKVDIEKSATDFVERMTNNDSYLPMEKVLPKHSLLYETFTVYNELTKVRYIDDNGRAQNFSSKEKRQIINELFKQQRKVKKEMLEAFLKNEYGIENPKVEGIEKSFNACLGTYHDLIKLGIRPELFEQPEHEQQFEQIVKILTVFEDRKMRRKQLEKFSNILTEEEQKQLERKHYKGWGRLSAKLIHGIVDQKTQKTILDYLIDDDDLPKNRNRNFMQLINDENLSFKEEIEKIAFDNDKSTEEIVQELAGSPAIKKGILQSLKIVEEIIDIMGELPTNIVVEMARENQTTAQGNRASKARMKYLEESIKKLGSSILEDEPISKDANLLRNDRLFLYYLQNGRDMYTGNELDINNLSSYDIDHIVPQSFVKDDSIDNRVLTTSSMNRGKSNTVPAESVVKKMRPTWERLLASGLISKKKFSYLTKATNGGLTEEDKAHFIQRQLVETRQITKNVAQILHQKYNNEQLSEKPVRVITLKSALASQFRKDFSLYKIRELNDYHHAQDAYLNGVIAQALLKVYPKLEPEFVYGEYQKVSIRALNKATAKKEFYSNIMNFFTSDEMVANEETGEVLWNRQRDIKTIKKVMNYHQMNIVKKVEIQTGAFTKESILPKGPSKKLIARKNNWAPVNYGGVDSPTVAYSVIITHEKGKAAKVVQQLVGIKILERQAFEQDEVAFLEEKGFIHPKVQLKLPKYSLYQFADGRRRLLASAEESQKGNQMVLPVHLIELLYHAKHVSDSSGKSLEYLNEHRHEFAELLEAILQFTEQYIDAGKNQKKVRDLYEKNQDADMRELASSFIQLLQLNKQGAPADFKFFGETIPRRRYKNTAEIVDATFINQSITGLYETQKRLV

SEQ ID NO: 827 - protein, 1327 aa, Artificial Sequence
  Cas9
MTEQQQPYNIGLDIGTSSIGWAVTDQNDKLLHIRGHNGIGVRLFKEGESAAERRGFRTTRRRLSRRRWRLRFLDRIFDAELAKVDPNFLARLKQSNISPLDPNKQMFGNILFDDPQFDDQKFHQQYPTIYHLRSALAQPDAPQADVRLIYLALHHMIKFRGHFLNGAAVEKFHGGQLHLESEFQELNQIFSNQQRDHVQLQTSSLDEVATILKDNQRTPSDRQRELSARLFVPVDKTIDKENKKLATELLKAVLGLKAKFDVILGVEATDPQAFKLQFSSDDFDDKIAELASELTDEANEILTVLQRLYFSLNLADILTNRQTKQVADSISTAMINRYDDHKHHLKMLKELEAQVTQEQRDGLKKAYNEYIDGDKPTIDTFYTNVKKNLDDSELANQIKSLIDLQAFMPKQRSKENGSIPHQLHQRELDQLIEVQGKYYPWLLAAKDKLDALIAFRVPYYVGPMIDPNQSDDPQNTKFAWMVRKEAGEITPWNFEEKVDKTSSATNFIKRMTTTDTYLLGEPVLPKNSLLYQQFTVLNELNKLKVNGKALTVDQKKYLYDHVCKKQRRVTLKKLSDCLVARGDFPMGAIFTGTTDQKNMNNTLKTYQDFQEIFGDEIDNPDRQVDFEKMIEWSTIFEDREIFKLKLAELNWLTSEQLERVSKKRYQGWGRLSQKLLTHIVNENGERIIDQLWNTNQNFMEIMGQDSVKQAIQEHNGANVAQTGINETIDELYTSPQNKKAIRQILLVVDDIKKAVGYAPANIMMEFAREDRDDHRLIASRARQLEKTYQEISKNWFDNESVTQELKDQIKNKTKFTDRLYLYFIQGGIDLYTGHPLNIDQLSSYDIDHILPQSFLLDNSLNNRVLTSQAENRVHKEDRLPGETVANKMRPTWKMMREQGLMTQRKYNNLTLKPDQISKFNNRGQFINRQLVETRQVIKLAADIMSQKYQADQTKVVTVKANLTHHMREKFNFYKSRNVNDYHHAFDAYLTLFVGNWLLKEYPKLQPYFVYGDFAKTGTNNLKSFNFLYRFERDHKLNDKGAIDTDKDQQLGYMKRIYRFKKMLVTKQLETNEGALYGQTLYPAPKNDKKTRNLINSKKNRPSDIYGGYSNENGSFLTLVKLKKGSKYDYRLVAVPVSKISEIKESELATIEKAIAPQFLKSSGKYRDFQVVLSKILINQKVIDDGMIFTIGSKSYKHNAKQVVLSDNSIQIVSTLSRISDKEKLITVFDEIVDITSKYLPWYKVNDVEKTKMLFRQMQDIDEMKKIIDNSLIGLHCNASITDLGKVGLSKYWGRFVLTAGISLTVDAQLIYQSPTGLFEHRVKVSDL

SEQ ID NO: 828 - protein, 1329 aa, Artificial Sequence
  Cas9
MNKQPYNIGLDIGTSSVGWSATELDNRLLHIKGHNGIGVRLFKEGESAADRRGFRTTRRRLARRKWRLRLLNEIFATEIAKVDPSFFARLKQSNVSPKDPNKTMFGNILFDDENLDDQKFHHDYKTIYHLRQAIINHPEQKFDIRLIYLAMHHIIKYRGHFLNQANVQDFKGGKIDLEKSFKALNDIFENQGRDLRLVTDEANQYVKVLSDNAKTRSDRKKELSKLLYVPIDKDTDKNSKKVTGEILKAILGNKAKFDVIFGIEVENPKEWVLTFNSDDFDDKIEGLSSQMTDEDSEILLILKELYFALNLSDILNNSVTDKNAKTLSEAMINRYDDHKNQLAMLKKVIDSSDKKHAKELKEAYSAYIDGENNKKISFEDLKKRIQKNLVDSELSQKINDLLDHDYFLPKQRSKENGAIPHQLQQQELDQIIESQKQYYPFLAELNPNEKRSRQAKYKLDELVAFRVSYYVGPMVEVTDSNQENNGKFAWMIRKEQGEITPWNFDEKVDRTETATKFITRMTTTDTYLIGEPVLPKNSLLYQKFVVLNELNNLKINQETITPGQKQYLYEHVMKKNKRVTLKKIADALVIKGDYPYAPEVKGTTDQKNLNNGLTTYIDLAKIFGNELDDVDREADFEKIIEWSTIFEDQHIFVLKLQELKWLTEKQRNQVVKLRYQGWGKLSKELLAGLVDDNGQRIIDLLWSDNQNFMQIVNQKSFKESIADHNGAHLEEKNLKDVINDLYTSPQNKKAIRQVILVVDDIINAVGYEPANIMMEFAREDSNDHRLTNSRSRQLENVYKDITNSWFDNDSVKDELEDKIKNKDKFTDRLYLYFTQGGKDLYTGEPLNIDDLSSYDIDHILPQSFILDNSLDNRVLTSQRNNRVSKEDQLPGELFGTKMHAFWKRLKAAHLISNKKYYNLTLTPNSISKFNNQGRFINRQLVETRQVIKLAAEILHNRYSEEKGTNIVTIKANLTHHMREKFNFYKNRNVNDYHHAFDAYLTAFVGNWLLQQYPKLKPYFVYGDFAKTEINNLKSFNMLYKFEQAHQLNEKDGKIAKDTDALLGYMKNVYHFKKMLVTKELETNHGALFNQTLYPSPAHDIKKRQLIKPKDNRPTDIYGGYTHEERKYMSLVKVIGKKDNEYRMANVPLLKINKNNDIKEILKSQFSNKKFEIVLPKVLKNQLFSENGALFVIGSKGYKYNANQLVLSDLDMKLLNDLSNNKSIDEVTINQLFKNIVDSTNKYMPLYEIKNLNEVVEKFNNLEFNDKKKTITDFLLATHANPTMSNLKNIGLPYFGRFIRNTGIKLSENANVIYQSPTGLFSRKIKISDF

SEQ ID NO: 829 - protein, 1330 aa, Artificial Sequence
  Cas9
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEGFQFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIEDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDYIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASASETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 830 - protein, 1330 aa, Artificial Sequence
  Cas9
MEKEYTIGLDIGTNSVGWAVLTDDYRLVARKMSIQGDSNRKKIKKNFWGARLFEEGKTAQFRRIKRTNRRRIARRRQRVLALQDIFAEEIHKKDPNFFARLEEGDRVEADKRFAKFPVFATLSEEKNYHRQYPTIYHLRHDLANSKEQADIRLVYLAIAHCLKYRGHFLFEGELDTENTSVTENYQQFLQAYQQFFPEPIGDLDDAVPILTERLSKAKRVEKVLAYYPSEKSTGNFAQFLKLMVGNQANFKKTFDLEEEMKLNFTRDCYEEDLNELLEKTSDDYAELFLKAKGVYDAILLSQILSKSDDETKAKLSANMKLRFEEHQRDLKQLKELVRRDLPKKYDDFFKNRSKNGYAGYVKGKATQEDFYKFLRTELAGLEESQSIMEKIDLEIYLLKQRTFANGVIPHQIHLVEMREIMDRQKRFYPFLKGAQGKIEKLLTFRIPYYVGPLAQEGQSPFAWIKRKSPSQITPWNFAEVVDKENSAIEFIERMTNQDTYLPKEKVLPKQSLIYQRFMIFNELTKVSYTDERGKSHYFSSEQKRKIFNELFKQHPRVTEKQLRKFLELNEQIDSTEIKGIETSFNASYSTYHDLLKLSDQMDTLLDDPDMTTMFEEIIKILTIFEDREMIREQLKPYETVLGLPAIKKLAKKHYTGWGRLSEKMIQGMREKQSRKTILDYLIDDDDFPCNRNRNFMQLINDDHLSFKETIANELIMSDSNVLLDQVKAIPGSPAVKKGIWQSIKIVEEIIGIIGKAPKNIVIEMARENQRTSRSRPRLKALEEALKNIDSPLLKDYPTDNQALQKDRLYLYYLQNGKDMYTGEPLEIHRLSEYDIDHIIPRSFIVDNSLDNKVLVSSKVNRGKLDNAPDPLVVKRMRSHWEKLHQAKLISDKKLANLTKQNLTEADKARFIQRQLVETRQITKHVANLLHQHFNLPEEVSATEKTSIITLKSTLTSQFRQMFDIYKVREINHHHHAHDAYLNGVVAMTLLKKYPKLAPEFVYGSYIKGDINQINKATAKKEFYSNIMKFFESEEIICDEQGEVIWNKKRDLSTIKKTIGAHQVNIVKKVEKQKGGFYKETINSKANPEKLIPRKASLDPLKYGGYGSPLVAYTVIFIFEKGKQKKVTKGIEGITVMEQLRFEQDPREFLKTKGYEGVKQWLILPKYILFEAQGGYRRMIASHQETQKANSLILPENLVTLLYHARHYDEINHKVSFDYVNAHKEGFNDIFDFISDFGVRYILAPQHLEKIKVAYEKNKEVDLKEMIDAILSLLKFTLFGASVEFKFFDIKILKRYKSLTDIWEATIIYQSVTGLYERRVEVRKLWDGERL

SEQ ID NO: 831 - protein, 1331 aa, Artificial Sequence
  Cas9
MNKQPYNIGLDIGTSSVGWSATELDNRLLHIKGHNGIGVRLFKEGESAADRRGFRTTRRRLARRKWRLRLLNEIFATEIAKVDPSFFARLKQSNVSPKDPNKTMFENILFDDENLDDQKFHHDYKTIYHLRQAIINHPEQKFDIRLIYLAMHHIIKYRGHFLNQANVQDFKGGKIDLEKSFKALNDIFENQGRDLRLVTDKANQYVKVLSDNAKTRSDRKKELSKLLYVPIDKDTDKNSKKVTGEILKAILGNKAKFDVIFGIEVENPKEWVLTFNSDDFDDKIEGLSSQMTDEDSEILLILKELYFALNLSDILNNSVTDKNAKTLSEAMINRYDDHKNQLAMLKKVIDSSDKKHAKELKEAYSAYIDGENNKKISFEDLKKRIQKNLVDSELSQKINDLLDHDYFLPKQRSKENGAIPHQLQQQELDQIIESQKQYYPFLAELNPNEKRSRQAKYKLDELVAFRVPYYVGPMVEVTDSNQENNGKFAWMIRKEQGEITPWNFDEKVDRTETATKFITRMTTTDTYLIGEPVLPKNSLLYQKFVVLNELNNLKINQEIITPGQKQYLYEHVMKKNKRVTLKKIADALVIKGDYPYAPEVKGTTDQKNLNNGLTTYIDLAKIFGNELDDVDREADFEKIIEWSTIFEDQHIFALKLQELKWLTEKQRNQVVKLRYQGWGKLSKELLAGLVDDNGQRIIDLLWSDNQNFMQIVNQKSFKESIADHNGAHLEEKNLKDVINDLYTSPQNKKAIRQVILVVDDIINAVGYEPANIMMEFAREDSNDHRLTNSRSRQLENVYKDITNSWFDNDSVKDELEDKIKNKDKFTDRLYLYFTQGGKDLYTGEPLNIDDLSSYDIDHILPQSFILDNSLDNRVLTSQRNNRVSKEDQLPGELFGTKMHAFWKRLKAAHLISNKKYYNLTLTPNSISKFNNQGRFINRQLVETRQVIKLAAEILHNRYSEEKGTNIVTIKANLTHHMREKFNFYKNRNVNDYHHAFDAYLTAFVGNWLLQQYPKLKPYFVYGDFAKTEINNLKSFNMLYKFEQAHQLNEKDGKIAKDADALLGYMKNVYHFKKMLVTKKLETNHGALFKQTLYPSPAHDIKKRQLIKPKDNRPTDIYGGYTHEERKYMSLVKVIGKKDNEYRMANVPLLKINKNNDIKEILKSQFSNKKFEIVLPKVLKNQLFSENGALFVIGSKGYKYNANQLVLSDLDMKLLNDLSNNKSIDEVTINQLFKNIVDSTNKYMPLYEIKNLNEVVEKFNNLEFNDKKKTITDFLLATHANPTMSNLKNIGLPSYFGRFTSGNAGIKLSENANVIYQSPTGLFSRKVKISDF

SEQ ID NO: 832 - protein, 1332 aa, Artificial Sequence
  Cas9
MKNRENIKYYIGVDIGTNSVGWAVIDENGNLLKKGKHHLWGSRLFDQAQTAQNRRNYRSSRRRYNKRRQRIGLLRLIMSDMVLEVDPSFFIRLEKTTFLDKEDKKAILKDNYKMNYNLFCDEDYNDKKYFKDYPTIYHLRKKLCESDEKADPRLIYLALHHIVKYRGNFLYEGQELHLEPSNKEEDLKILFDILGKNNDTVYDISEEQIQFILKTVVENISKTAKVDECMSQLKLNSEDKKIVKEFMRGLVGNKFNVSKLYMHEDLQFDDEDLKLQFSDKSYEEKITEYENVLEEKMEFIDLMQRFYSWIELSKIVGSDSQHASISGAMVNIYESHREDLRTLKEVMLKIGKKEYDEMFKPTSKNVVNYYNYVNPVACSGDKTDGFYKYVKKAIEKSDDSRKDEILQKIANETYMLKQTSKNNAYIPYQMQKDELIKILDHQEKYYPVLKENRDKIISILEFRIPYYYGPLDGNKQFGWLIKKKGKENERILPWNHQEIVDVQETAAQFIKKLTNYCTYLPIEKVMPQKSLTCSMYEVLSEVNKIRIDGKLLPIDTKNRLIEDLFFKRKTVKEKDLINWLKQNQLTVGEITGYQKEKAFSSSLAPWIDFKEIFDEINDSNYDLIEKIIEDMTIFNEGSILKERLKKAYNLDQNKVKKIMKLKYSGWSRLSKKLINGIRADNKFGSSVSILDVMKESHMALMEIINDQDLGFKQIIEKENFKNETGSFEYEDIENLAGSPALKRGIWQTLQVIEEIKNYMGHEPKNIYIEFAREEQEKVRTTTRVKKLKSIYNDIKNQLDVHGKEVYSNLNKQDEKSSIEKRLYLYYTQLGKCMYSGESLDIDKLSNYEIDHIFPRTLTSDDSLDNLVLVKKKENQRKLDDLVLPLEIRNKMEVFWKKLYDNGLITQTKYYRLMRDEFRRDQIDKFINRQLVETRQIIKHVANIIENHYEDTKVFTVRANLSHEFREKYGIYKNRNVNDFHHAHDAYIACIIGRYIQIRFPGLEAKYVYGQYMQNVKKTKNNIDKENHGFIINSMKYECIDEDTGEVIWNPERILDYIKCFNYRDVYITKKLDTNNRELFNVTILPNDKNSEKGKTKATIPVNKLRSNVRKYGGFSGLQSDIVAIEGKKGKKIDRRLINLPILLRYVSIEDQCKYIMENNKYSDVKIIKKIKKNQLIEIDGICYYLKSADELDTAYQLILSRDDNEMIYRIDRAIQNNDFSYFDNKKENIDELYRLICHKMIENYPKYKKKVYEFIKEREEEFFELDNSQKCIVIFEMIRVMKRGEQYINIPFEPYNLKNDRKGRLNCQSILLDNTYFYDVSITGIYSKKYKL

SEQ ID NO: 833 - protein, 1332 aa, Artificial Sequence
  Cas9
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKSDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGPSDVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLEDN

SEQ ID NO: 834 - protein, 1332 aa, Artificial Sequence
  Cas9
MMKEYSIGLDIGSSSVGFVAVDDQYRVVRAKGKNVIGTRLFDEGKTAADRRGLRTTRRRLSRRKWRLRLLRGIFEPHINEIDESFFMRLKESNISPKDSNKHFPGDILFNDRSDREFYENYPTIYHLRQALKTEKRQFDIREIYLAMHHIVKYRGHFLEGGTVTDFEVGELDLAGKFSRLNELFESINLEVPFVLRLDNLEDVKAVLIDSQRSAQDRQRTLTPDIYVPSTDKITEKRFKGIATELLKAIVGNKAKFDVLAGLELDKEEAKLWALTFDSETFDEDIEQLEGDMTEATQDLIEILKSLRSLIRLAVNMPEGVSLSEMMIQRYEDHADHLKLLRDIIHNTDAEKAAGLQAAYDGYIDGVKGKKTPVDDFYKAIKKNLDDSEAAHQILALIDKNEFMPKQRSKSNGWIPHQIQQKELDRIIENQKQYYPWLADVNPNESRRKVAPYKIDELVTFRVPYYVGPLVTSEEQKKYGSKFAWMVRKEEKGEITPWNFDQKVDRAASATEFINRMTTMDTYLLNEDVLPAHSLIYQKYEVLNELNKVKINGDAITPELKQKIYHDLFEKQTTVSIKNLQTYLVSESEASEVPEIKGLADEKKFLSGLTTYHDLMKIFDRNVVNDPERAEDFEKIIRWSTVFEDKHIYREKLDSLSWLTTDQKDRLAVKRYRGWGRLSEKLLIGLRDEGHRSIMDYLWETTSNFMQIQAQNDFSEKIAAENKEFLDNTQSVQGIINELYTSPQNKKAIRQTLLVVEDIKKAFHGEAPKRIFVEFARENESTPQRSIQRQRQVENAYEKVTQNLLVDDKIRAELKDSINEKRLFHDRLFLYFMQGGIDMYSGKKINIDNLSAYDIDHILPQSFTVDNSLDNRVLTNQKDNREKGNSLPSELYRGSMKETWEMMRNQGLLSKGKFHRLMMTPNSMTAYDQQGFINRQLVETRQVIKLAVEILASEFDQADEKVEIVSVKAGLTHQMRQDFSLIKNRDVNDYHHAFDAYLTAFVGTYLLKRYPKLRPYFVYGEFKKFSQKQANLTNFNFLWALKHKDQVAVEDTGEKIWNKPQDLAYIRHLFAFKKILISREVSERHGALFDQTLYKASDDKASGQGSKKLIPAKDNRPTELYGGYSGQTSAFMAIVKVTKGKKTKYLVVGVPTAAISQLQGMDVKSSQYTEKIYNILSPKLLSKNDDFEVIVPKVRYRQLILDNNQLFTLGSDTYKYNARQLVLSNEVLAVINRDKSFIDKKLSEEAENQALNDAFDEIVVAMDKHFDLYDKNGFREKVKAGKQRFEELPVSLFSEDKENEGITKRTVLKRILQGLHANATTSDLKVLDGKFYN

SEQ ID NO: 835 - protein, 1333 aa, Artificial Sequence
  Cas9
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 836 - protein, 1333 aa, Artificial Sequence
  Cas9
MSQNIVDYCIGLDLGTGSVGWAVVDMNHRLMKRNGKHLWGSRLFSNAETAANRRASRSIRRRYNKRRERIRLLRAILQDMVLENDPTFFIRLEHTSFLDEEDKANYLGADYKDNYNLFIDEDFNDYTYYHKYPTIYHLRKALCESTEKADPRLIYLALHHIVKYRGNFLYEGQKFNMDASNIEDRLSDVFTQFADFNNIPYEDDEKKNLEILEILKKPLSKKAKVDEVMALIAPEKDFKSAYKELVTGIAGNKMNVTKMILCEPIKQGDSEIKLKFSDSNYDDQFSEVENDLGEYVEFIDSLHNIYSWVELQTIMGATHTYNASISEAMVSRYNKHHEDLQLLKKCIKDNVPKKYFDMFRNDSEKLKGYYNYINHPSKAPVDEFYKYVKKCIEKVDTPEAKQILHDIELENFLLKQNSRTNGSVPYQMQLDEMIKIIDNQAKYYPVLKEKREQLLSILTFKIPYYFGPLNETSEHAWIKRLEGKENQRILPWNYQDIVDVDATAEGFIKRMRSYCTYFPDEEVLPKNSLIVSKYEVYNELNKIRVDDKLLEVDIKNDIYNELFMNNKTVTEKKLKNWLVNNQCCNKNAEIKGFQKENQFSTSLTPWIDFTNIFGEINQSNFDLIEDIIYDLTVFEDKKIMKRRLKKKYALPDDKIKQILKLKYKDWSRLSKKLLDGIVADNKFGSSVTVLDVLEMSRLNLMEIINDRDLGYAQMIEAAASCPEDGKFTYKEVQRLAGSPALKRGIWQSLQIVEEITKVMKCRPKYIYIEFERSEETKERTESKIKKLENVYKDLDEQTKVEYKTVLEELKGFDNTKKISSDSLFLYFTQLGKCMYSGKKLDIDSLDKYQIDHIVPQSLVKDDSFDNRVLVVPSENQRKLDDLVVPSDIRVKMNSFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDKKRWKDGFVINSMNYPYEVDGELIWNPDIINEIRKCFYYKDCYCTTKLDQKSGQMFNLTVLPNDAHSPKGTTEAVIPVNKNRKDVNKYGGFSGLQYVIVAIEGKKKRGKKTKLVKKISGVPLHLKAASLDEKIKYIEEKENLTDVKIIKDSIPVNQMIEMDGGEYLLTSPIEFVNGRQLVLNEKQCALIADIYNAIYKQDCDNLDDVLMIQLYIELINKMKALYPAYQSIAEKFESMTEDYVAVSKEEKADIIKQMLIIMHRGPRNGKIQYADFNVGDRIGRKNKMSLDLERVTFVSQSPTGIYTKKYKL

SEQ ID NO: 837 - protein, 1333 aa, Artificial Sequence
  Cas9
MGKEYYLGLDIGTDSVGWAVCDTNYKIPKFKGNAMWGIRLFEKSNSAEERRGFRSSRRRTQRKRERLKLLEMLFDEEISKIDPAFFIKLRESNLYLEDKSTKIPYCVFSDENYTDKDFHRDYPTIYHLRNELIKSNKPHDVRLVYLALHHIIKNRGHFLFDYSYKNDKSGDFMPIYNDLKNYFYDNYEIELDCSDVDEFANTLKDKSKGKTKKNAEIAELFGVSKKYDKVLYSALSLLSGSSVKLFDIFDDEALKDVEKKSVSFSSGFDDNANDFQSYLGERFELLEKLKAVYDWAVLADILDGKEYISEAKVAIYEKHKRDLKTLKKYIKIYMPEKKAEIFNISSKDNNYVAYSKHIKTSNGTGVLISTCTQEEFCAYLKKTLGICKDASYEEMFKEIENSTFMPKQVTKDNGVVPMQVNEKELVAILDNAKEYLPFLLNKDNDGKTVYDKIKALFEYRIPYYIGPLNTHSTKSWLVRSNEKIYPWNIEDVVDFDKSAEKFIENLTSKCTYLPQYDVIPKHSLLYNKFCVLNELNNLKIDGEKISVQLKQDIYNDLFKKYYKVTNKKLCDYLKSRNIAFDEISGIDNDFKSSLKSYKDLVAYNLTDEQKEEIVKAITIFGDDKKLLKKRLKNEFGGCLSDDEIKKICKLKYTGWSKLSREFLTDVTAVYKETGELINIICALWETNYNLTSLLYSDEFCCDDKENKTFNDKINELNSFGNDKTLNQIVEELYVSPLVKRPIYQSLLITKELEKIMKCPPKKIFVEVARGAEEKKRTVSRRNKLLDLYKSCKNDYPLLFDELQNNTTDDELKSDKLYLYFTQFGKCMYTGENIELGDLFNKNLYDIDHIYPQSKIKDDSLDNRVLVKKTTNAKKDNEYPLSSQIREKMTPHWKALLDKGLINKKKYERLVRNYPLSDEELSQFISRQLVETRQSTKAVANILEQLYPRPDTEIVYVKAALASEFRHQYDMLKCREVNDLHHAKDAYLNIVVGNAYNGKFTHNKANFIKGLQNNDKAYTVKLDSMLKHNIDGAWIADNNESLNIVKSTMNKNNIRYTRYAFEKKGGLFKVTILKKGNGQASIKKNDKRNSIEKYGGYNQVSSTYFSCVEHGKDNNRMISMFSVNLYDKNKYEENPIAYLIENYGLINPIIKVKKVKIQSCISFDNMLCHLGGKDSGGSQISYRPGVQLVLGYDNERYIRNVIRCAGGDLHLQTSKNEKDIVTAEKNIELFNLLIEKMKNNIYGVLYSNLGDKLYCSKEKFEKLDIVEQCNVIKNVLTILKNNASKGDLKSIGIKANGAIRLNNNISEIKKVKSIKLINQSVTGLFEQEIELLNL

SEQ ID NO: 838 - protein, 1333 aa, Artificial Sequence
  Cas9
MSQNIVDYCIGLDLGTGSVGWAVVDMNHRLMKRNGKHLWGSRLFSNAETAATRRSSRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDVFTQFADFNNIPYEDDEKKNLEILEILKKPLSKKAKVDEVMALISPEKEFKSAYKELVTGIAGNKMNVTKMILCESIKQGDSEIKLKFSDSNYDDQFSEVENDLGEYVEFIDSLHNIYSWVELQTIMGATHTDNASISEAMVSRYNKHHEDLQLLKKCIKDNVPKKYFDMFRNDSEKVKGYYNYINRPNKAPVDEFYKFVKKCIEKVDTPEAKQILHDIELENFLLKQNSRTNGSVPYQMQLDEMIKIIDNQAKYYPVLKEKREQLLSILTFRIPYYFGPLNETSEHAWIKRLEGKENQRILPWNYQDTVDVDATAEGFIKRMRSYCTYFPDEEVLPKNSLIVSKYEVYNELNKIRVDDKLLEVDVKNDIYNELFMKNKTVTEKKLKNWLVNNQCCRKDAEIKGFQKENQFSTSLTPWIDFTNIFGKIDQSNFDLIEKIIYDLTVFEDKKIMKRRLKKKYALPDDKIKQILKLKYKDWSRLSKKLLDGIVADNRFGSSVTVLDVLEMSRLNLMEIINDKELGYAQMIEEASSCPKDGKFTYEEVAKLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVLPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKKWKDGFVINSMNYPYEVDGKLIWNPDLINEIKKCFYYKDCYCTTKLDQKSGQMFNLTVLPNDAHSAKGTTEAVIPVNKNRKDVNKYGGFSGLQYVIAAIEGTKKKGKKLVKVRKLSGIPLYLKQADIKEQIEYVEKEEKLSDVKIIKNNIPLNQLIEIDGRQYLLTSPTECVNAMQLVLNEEQCKLIADIYNAIYKQDFDGLDNMLMIQLYLQLIDKLKTLYPIYMGIVEKFEKLTEDFVSISKEEKANVIKQMLIIMHKGPQNGNIIYDDFNVGKRIGRLNGRTFYLDNIEFISQSPTGIYTKKYKL

SEQ ID NO: 839 - protein, 1333 aa, Artificial Sequence
  Cas9
MYTYYFKESEMVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 840 - protein, 1334 aa, Artificial Sequence
  Cas9
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 841 - protein, 1334 aa, Artificial Sequence
  Cas9
MKKPYTIGLDIGTNSVGWAALTDQYDLVKRKMKVAGNSEKKQIKKNLWGVRLVDEGKTAAHRRVNRTTRRRIERRRNRISYLQEIFTAEMFEVDANFFYRLEDSFYIESEKRQSRHPFFATIEEEVAYHENYRTIYHLREKLVNSSDKADLRLVYLALAHIIKYRGNFLIEGKLDTKNTSVDEVFKQFIKTYNQVFASDIEEGSLTRIEENNEVAKIFSEKLTKREKLDKILNLYPNEKSTDLFAQFISLIIGSKGNFKKFFNLTEKTDIECAKDSYEEDLEVLLARVGDEYAEIFVAAKNAYNAVVLSSIITVSNTETKAKLSASMIERFDKHDKDLKRMKAFFKVRLPENFNEVFNDVEKDGYAGYIEGKTKQEAFYKYMKKMLEHVEGADYFINQIEEENFLRKQRTFDNGAIPHQLHLEELEAILHQQAKYYPFLKVDYEKIKSLVTFRIPYFVGPLANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMNDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 842 - protein, 1334 aa, Artificial Sequence
  Cas9
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 843 - protein, 1334 aa, Artificial Sequence
  Cas9
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMQKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKEQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 844 - protein, 1334 aa, Artificial Sequence
  Cas9
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEEGTLAKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLRELKAFIKLHLPKQYEEIFSNVAIDGYAGYIDGKTKQVDFYKYLKTLLENIEGADYFIAKIEEENFLRKQRTFDNGAIPHQLHLEELEAILHQQAKYYPFFKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKKKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 845 - protein, 1334 aa, Artificial Sequence
  Cas9
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREELVNSSEKADLRLVYLALAHIIKYRGNFLIEGALDTKNTSVDEVYKQFIQTYNQVFMSNIEEGALAKVEENLEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTTLENVEGADYFITKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQESLDSPLNAEMLEDIVKILTVFEDKRMIKEQLQQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNYGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHREAFSELLAQVSEFATRYTLADANLSKINNLFEQNKEGDIKAIAQSFVDLMVFNAMGAPASFKFFEATIDRKRYTNLKELLSSTIIYQSITGLYESRKRLDD

SEQ ID NO: 846 - protein, 1334 aa, Artificial Sequence
  Cas9
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEEGTLAKMEENTTVANILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGKTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNMEMLEDIVKILTVFEDKRMIKEQLQQFSGVLDGAVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLRATIIYQSITGLYEARKRLDG

SEQ ID NO: 847 - protein, 1334 aa, Artificial Sequence
  Cas9
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEEGTLAKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGKTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 848 - protein, 1334 aa, Artificial Sequence
  Cas9
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREELVNSSEKADLRLVYLALAHIIKYRGNFLIEGALDTKNTSVDEVYKQFIQTYNQVFMSNIEEGALAKVEENLEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTTLENVEGADYFITKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQESLDSPLNAEMLEDIVKILTVFEDKRMIKEQLQQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVTNILHQRFNNETDNYGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHREAFSELLAQVSEFATRYTLADANLSKINNLFEQNKEGDIKAIAQSFVDLMVFNAMGAPASFKFFEATIDRKRYTNLKELLSSTIIYQSITGLYESRKRLDD

SEQ ID NO: 849 - protein, 1334 aa, Artificial Sequence
  Cas9
MKKEYTIGLDIGTNSVGWAVLTENYDLVKKKMKVYGNTETKYLKKNLWGVRLFDEGETAADRRLKRTTRRRYSRRRNRICRLQDLFTEEMNQVDANFFHRLQESFLVPDEKEFERHAIFGKMEEEVSYYREFPTIYHLRKHLADTSEQADLRLVYLALAHIVKYRGHFLIEGELNTENSSVSETFRTFIQVYNQIFRENEVPLAVPDNIEELFSEKVSRARKVEAILSVYSEEKSTGTLAQFLKLMVGNQGRFKKTFDLEEDGIIQIPKEEYEEELETLLAIIGDEYAEIFSATKSVYDAVALSGILSVTDGDTKAKLSASMVERYEAHQKDLVQFKQFIRKELPEMYAPIFRDNSVSGYAGYVENSKVVTQAEFYKYIKKAIEKVPGAEYFLEKIEQETFLDKQRTFNNGVIPHQIHLEELEAIIQKQATYYPFLADNKEEMKQLVTFRIPYYVGPLADGNSPFAWLERISSEPIRPGNLAEVVDIKKSATKFIERMTNFDTYLPTEKVLPKHSMIYEKYMVYNELTKVSYVDERGMNQRFSGEEKKQIVEELFKQSRKVTKKLLEKFLSNEFGLVDVAIKGIETSFNAGYGTYHDFLKIGITREQLDKEENSETLEEIVKILTVFEDRKMIREQLKKYTYLFDEEVLKKLERRHYTGWGRLSAKLLIGIKEKRTHKTILDYLIEDDGGKQPINRNLMQLINDSDLSFKSEIAEAQSDMNTEDLHEVVQNLAGSPAIKKGILQSLKIVDELVDIMGSLPKNIVVEMARENQTTSRGRTNSNPRMKALEEAMRNLRSNLLKEYPTDNQALQNDRLYLYYLQNGKDMYTGLDLSLHNLSSYDIDHIVPQSFTTDNSLDNRVLVSSKENRGKKDDVPSKEVVQKNITLWETLKNSNLISQKKYDNLTKGLRGGLTEDDRAHFIKRQLVETRQITKHVARILDQRFNSQKDEEGKTIRAVRVVTLKSSLTSQFRKQFAIHKVREINDYHHGHDAYLNGVVANSLLRVYPQLQPEFVYGDYPKFNAYKANKATAKKQLYTNIMKFFAEDAVIIDENGEILWDKKNIATVKKVMSYPQMNIVKKPEIQTGSFSKETIKPKGDSDKLISRKTNWSPKLYGGFDSPQVAYSVIITYEKGKKKVRAKAIVGITIMEQSLFKKDPVSLLEEKGYANPEVLIHLPKYTLYELENGRRRLLASANEAQKGNQLVLPASLVTLLYHAKQVDEDSGKSEEYVREHRAEFAEILNYVQAFSETKILANKNLQTILKLYEENKEADIKEIAESFVNLMKFSAYGAPMDFKFFGKTIPRSRYTSVGELLSATIINQSITGLYETRRKLVD

SEQ ID NO: 850 - protein, 1334 aa, Artificial Sequence
  Cas9
MRKPYTIGLDIGTNSVGWAVLTDQYNLVKRKMKVAGSAEKKQIKKNFWGVRLFDEGEVAAGRRMNRTTRRRIERRRNRIAYLQEIFAAEMAEVDANFFYRLEDSFYIESEKRHSRHPFFATIEEEVAYHEEYKTIYHLREKLVNSSDKADLRLVYLALAHIIKYRGNFLIEGMLDTKNTSVDEVFKQFIQTYNQIFASDIEEGSLTRLEENKEVAEILSEKLTRREKLDKILKLYTGEKSTGMFARFINLIIGSKGDFKKVFDLDEKAEIECAKDTYEEDLEALLAKIGDEYAEIFVAAKSTYNAVVLSNIITVTDTETKAKLSASMIERFDKHAKDLKRLKAFFKMQLPEKFNEVFNDIEKDGYAGYIDGKTTQEKFYKYMKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMNDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 851 - protein, 1335 aa, Artificial Sequence
  Cas9
MKNYTIGLDIGTNSVGWAVIKDDLTLVRKKIKISGNTDKKEVKKNLWGSFLFEQGDTAQDTRVKRIARRRYERRRFRIRELQKIFDKSMGEVDSNFFHRLDESFLVEEDKEYSKYPIFSNEKEDKNYYDKYPTIYHLRKDLADSNQKADLRLIYLALAHMIKYRGHFLIEGDLKMDGISISESFQEFIDSYNEVCALEDENLEIIYNDELLTQIENIFKQDISRSKKLDQAIALFQGVKRQSLFGIFLTLIVGNKANFQKIFNLEDDIKLDLKEEDYDENLEELLSNIDEGYRDVFLQAKNVYNAIELSKILKTDGKETKAPLSAQMVELYNQHREDLKKYKDYIKAYLPEKYGETFKDATKNGYAGYIDGKTSQEDFYKFVKAQLKGEENGEYFLEAIENENFLRKQRSFYNGVIPYQIHLQELTAVLDQQEKHYSFLKENRDKIISLLTFRIPYYVGPLAKGESRFAWLERSNSEEKIKPWNFDKIVDIDKSAELFIENLTSRDTYLPDEPVLPKRSLIYQKFTIFNELTKISYIDERGILQNFSSREKIAIFNDLFKNKSKVTKNQLVKYIENKEQIIAPEIKGIEDSFNSNYSTYIDLSKIPDMKKLLEKDEDEILEEIIKILTIFEDRKMRKRQLMKFKDKLSEKAINQLSKKHYTGWGQLSEKLINGIRDEQSNKTILDYLIEDNGCPKNMNRNFMQLINDDTLSFKEKIRKAQDINQVNDIKEIVKDLPGSPAIKKGIYQSIRIVDEIIRKMKDRPKNIVIEMARENQTTQEGKNKSKARLKKIQEGLENLDSVHVEKQALDEEMLKSPKYYLYCLQNGKDIYTGKDLDIGQLQTYDIDHIIPRSFITDNSFDNLVLTSSTVNRGKLDNVPSPDIVRQQKGFWKQLLRAGLMSQRKFNNLTKGKLTDRDRQQFINRQLVETRQITKHVANLLSHHLNEKKEVGEINIVLLKSALTSQFRKKFDFYKVREVNDYHHAHDAYLNGVIALKLLELYPYMAKDLIYGKYSYHRKIEGDKATQAKYKMSNIIERFSQDLLANPDGEIAWEKDKDLNTIRKVLSSKQINIIKKAEEGKGRLFKETINSRPSKKTEKRIPIKNNLDPNIYGGYIEEKMAYYIAINYLENGKTKKAIVGISIKDKKDFEGQTTEYLGKIGFNKASIINSFKNYTLFELENGSRRMIVGASKENDSKGELQKGNQMYLPQNLLEFVYHLKHYNEDETSHKFIVEHKAYFDELLNYIVEFANKYLELENSIEKIKDLYHGKGPDVEEKELVESFINLLAITKCGPAADITFLGEKISRKRYRSTNCLWGSEVIFQSPTGLYETRLRLE

SEQ ID NO: 852 - protein, 1336 aa, Artificial Sequence
  Cas9
MDDNYQLMHAKGKYGYGTRIYSEGQTAADRRGFRTTRRRLNRRKWRLRLLQDFFEPYILPQDEAFFIRQKQSNLVPQDTKKQYPESVLFDDTSDKDFYTEYPTIYHLRQALMTENRQFDIREVYLAIHHIVKYRGHFLNNAPVKTFKSGNLDLAIKFNELNEEFKSVYPDLELQFNLDQIDEIKKILLDSTKSRFDRQGEAVKLIYTVSEVKTIEKLQNKIVKQFLSGILGLNTRFDVLTNTESDDSMWKFSLDSESSDDALDEIIAQLDDPAIHVVELVNEIHSSITLAGIVPEGQGLSESMVEKYEAHKAHLQLLKAVEKLVDKKAADKLEVAYDQYINGKDSKQFIKEDFYKAVQSEIKGVAGDEVAEINQLIELDQFMPKQRTKENGAIPHQLHQHELDVIIENQSKYYDWLGEKVGNEYKLDKLVSFRVPYYVGPLVDTASKEKKDETRFAWMVRKNPESTEAITPWNFEDIVDKNASAENFIKRMTTKDKYLLNEDVLPKCSLLTQDFEVYNELNNIRVNGEKFTAEQKQLIHDELFTKHASVSIKQLKDFLVSELMYVRDNLKVEGLADEKKLMSSLSTQFDYQKIIPDQINDVKYREDIEQIIEWSTIFEDAAIFKTKLKEIDWLTDEQRNKLANKRYRGWGSLSKRLLACLVDENGQRIIDILRDSSDNFMMIVNRPEFKQAIFDENANLTETNSKKDMFEMIDNFYTSPQNKKAIRQVLLVVQDIQNAMGGVAPQKIFIEFAREDEVNGRRTNSRYSQIREMYSKVTDDVINKTVRGELEANKGSLNKEKLFLYFLQGGIDLYSGKTINIDNISSYDVDHVLPQSFIKDDSINNKVLVNAKGNRVKNDNVPMELFGAKMYPTWKRMVDTGIMSKAKFKNLTLNPDNVDKFKAEGFINRQLVETRQIIKLVAQILNDKLGDDTKIVSVKANLTHDMRVFFDFPKNRNVNNYHHAFDAYLSAFVGTYLYKRYPKLQPYFVYGEFKKMDKLKNMTSFDFLRDLKHTDKVVDKDTGEIIADKLAVITNMNKIYDFKKVLVTHEVHENSGAMYDQTLYPAKLDKSLGRKGAKQLIPKKDDMPTALYGGYTGSKDAFMSIVRLKKKDEVYYKVIGIPVRIADSVQHGKEVDVEALTQFIETKFTKENLNKKTGEITRKVEWFELVLPKVLFGQAVFDGGQPFMLGSSTYPHNLRELVLTKDSVKKIAGKESNKSYLDAYDEIMEAMNKYFPLYDTNKFREKVIEGRSKFIDLPDKDEYENNKLVQVGKSTIIDRMFIGLHANAARTDLKNIGITTPFGFMQQASGIKLTKDTVVLFQSSTGLFERKVALKDL

SEQ ID NO: 853 - protein, 1336 aa, Artificial Sequence
  Cas9
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGYLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKIHPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAHIFGIEKAFNASYSTYHDFMKLAKTNQKSMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDIYTGEPLDIENLHQYEVDHIIPRSFIVDNSIDNKVLVASKQNQKKRDDVPNKQIVNEQRIFWNQLKEAKLISPKKYAYLTKIELTPEDKARFIQRQLVETRQITKHVANILHQSFHQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSYHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKDKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 854 - protein, 1336 aa, Artificial Sequence
  Cas9
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 855 - protein, 1337 aa, Artificial Sequence
  Cas9
MKNMKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 856 - protein, 1337 aa, Artificial Sequence
  Cas9
MKKFENYYLGLDIGTSSIGWAVTNSQYDILKFNGKYMWGTRLFPEANTAQERRIHRSSRRRLKRRKERIQILQMLFDKEIAKIDSGFFQRLKDSKYYKEDKTEKQTNSIFHDKDYSDKEYHQDFPTIYHLRKFLLEGNKPKDIRFVYLALHHILTHRGHFLFPDMEVSNVTEFSNIFSELKQYLYDEMDLDFEWKNGKLNEVENILKDRNLAKSEKEKKLCGIIELEGKIDNQRKAMIGMMCGCKKKFSDLFQNENYRELEISSFSFADSSYEEKRDELEGILAENILCLDYLKTIYDWGKLSDILQGEESISVAKVKSYEEHQLDLKYLKNILKLYSHKEKENVFRKKEGKYPKYISGKLSQEEFNKSIKKILEEIKSVKQEDRKVFDTLLKRASNNLLCPKQVIKENGVIPYQIHKFELEKILRNMADFFPMLKEKKDGKTLSEKIISVFTFRIPYYVGPLNQNSDRAWLVKNKDEKIYPWNFEEIVNLEESAEKFIQNLTNKCTYLVLEDVLPKSSILYSKFMVLNELNNLKIDGEAISVDLKQKIYLNLFQKYKKVTLKKLKGYLKSENILIDTSTQITGIDGDFKSSLGSYLDFYNILGDKVKTDFGKKLIENCILWITLYTGEKKLLKNKIIANYKGELSEEEIKKIVNLKYKDWGRLSYAFLEEIQSASLETGELRNIIQMMWETNNNLMELLSSNYQFLSEIEKRNSVVAIGKEFNYETILGDSYASPSVKRMIWQSLSVVDEIKKIMKKAPKKIFIEMARQEDMKKERKESRKSTFLTLYKSIKEEGRDWIKEIENWSDSEFRSKKLYLYYTQMGKCMYTGEKISLDQLFNKNIYDIDHIYPRSKTKDDSIENIVLVKRNINAKKTDEYPLERNIQQKQHDFWKMLHSKKLIGDKKYERLTRTTEFTDEELSDFIARQLVETRQSTKIVADILKNLFPETKIVYVKANLTSDFRKNFKILKSRDINDYHHAHDAYLNIVTGNVYNIKFTDNPRNFIKDKKLEGKKYNLKVEKIFEYRKENESFWNPKTMVTKIENYIFKKRPQFTRYSFEQHGGFFDQNIVDKESCKKGTGYIPIKSSNAILYNTSKYGGYGSVTGTYFFLVEHTMKGKRIRTIEMMPLYLSKKIHSKEELEKYCKEKLELQKPSVRLARIKYNSLLKINGFPYHITGKTNDSYWIMSAIQLLLSKNYYEYLRKLYIFCKEERLEEEIVGEKNIKLYTCILEKLEKSIYSHKLLNINYNGKSKNLKDILESEKENFLLLSEKKQAQILIEIFTLLESNNFGANLESFGCGKKCGITKINKNIDKLEEVLLINQSPTGLFENSIDLKKV

SEQ ID NO: 857 - protein, 1337 aa, Artificial Sequence
  Cas9
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLTYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 858 - protein, 1337 aa, Artificial Sequence
  Cas9
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSCEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 859 - protein, 1337 aa, Artificial Sequence
  Cas9
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 860 - protein, 1337 aa, Artificial Sequence
  Cas9
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 861 - protein, 1338 aa, Artificial Sequence
  Cas9
MQDYYLGLDIGTNSVGWAVTDENYNLLRKKGKDLWGVRLFKEAQPATERRGHRSSRRRTIRKSLRKQLLRELFEEEINAIDKDFFLRLDESKYWLEDKKIEGKYSLFNDENFTDKDYYEKFPTIFHLRKALIESDDKEDIRLYFLAINQMMKRRGHFLIDGKLSNVEDITPFKECIQNLINEELDTEIETEFYDKAIKIVSDYSLKKTEKKNLIKDLVKETDSIEDSKKIINIFNLLISGKSKVNGIFDDEEILEKIKEDNKEDFYLTSEKYEENLEYFSQLLDYRFELISSLKSIYDYIILQEVLKGKKYLSYAQVERYKNHKEDLRKLKQLIKKYDKNGKIYYQIFRDENFKKGYVAYLGYYKKNKKNVPVKKCDYDTFSKNIKSTLDKICDKEDPLYIELIDKIEKGGFLLKQIVSTNSVIPHQVHELELDKILENLEKNYPSFKEISDGVSKIDKIKMIFNFRIPYYVGPLNDYHKDKVNSNTWIVKNEGFENENIRPWNFSKIVDEHACEEEFIKRMINECSYIPGEKVLPKSSLLYSEYMVLNELNNLRVNGDKLNPKIKKEIVENIYKKERKVTLKKIRNFLIINNYVDSKVEFSGLSDGIKANMSSYIDFAEILDDNFDNNMVEDLIEQITIHVGNVKLLTEKISNKYPNLEKKQINKIVNLKFKDWARFSRKLLVGIEGTEKETGEINTIIGFLRETNENFMELMSNRYTFSEEISEIKKKYIPNKLSKQIVDDLYVSPAVKKMIWQVLNINDELIKVLGKQPKKIFIEMARGKEEKPEVKDSRKNKLIELYKNLGKEGKEWLNRIEDKTEADFRNRALYLYYTQMGRCMYTGEIIDIERLYDKELYDLDHIIPRKMKKDDSIHKNLVLVTRNSNQYEKKDNYPVPEVIKSRENVRHLWYALKKKGLITEEKYNRLTRINPLSDKELSEFIERQLVETRQTTKVVKDLFENYYTDSKIVTVKAGLVSELRRDFEVLKCREINDLNHAHDAFLNIIVGDVWSKKFTSNPYNFVKKNREKYTLNNIFTKNQKDLRGNEIWNCAEGKKRIIKTLNKPSVLFSVENFEQTGQLFDQNIIGKQDYKEKTSYVPIKGDERLQDISKYGGYRGISGAYFFIVEHTEKNKRVKTIESLPIYMKSYVEENGLLDFCTNEMKLVDPKIIVKKLNYKSEIIVDGFKYLISGKTENRLSLETNEYLYWNHTQTTDIKKILNINEKIELEKYNGDIESERENIIKYIQIILEKFKLKPFIKRRNLPNIEINFADYETEKLLQLLVNLIPLTTKYVSPVDLTVISGSKYAGKVLIPKKISNLNEVIFISKSITGIYESRRRII

SEQ ID NO: 862 - protein, 1338 aa, Artificial Sequence
  Cas9
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 863 - protein, 1338 aa, Artificial Sequence
  Cas9
MTKPYSIGLDIGTNSVGWAVVTDGYKVPAKKMKVLGNTDKSHIKKNLLGALLFDSGNTAKDRRLKRTARRRYTRRRNRILYLQEIFAEEMAKADESFFQRLNESFLTNDDKEFDSHPIFGNKAEEEAHHHKFPTIFHLRKHLADSTEKSDLRLIYLALAHMIKFRGHFLIEGQLKAENTNVQTLFDDFVEVYDKTVEESHLSEISVSSILTEKISKSRRLENLIKYYPTEKKNTLFGNLIALSLGLQPNFKTNFKLSEDAKLQFSKDTYEEDLGELLGKIGDNYADLFISAKNLYDAILLSGILTIDDNTTKAPLSASMIKRYEEHQEDLAQLKKFIRQNLPDQYSEVFSDKTKDGYAGYIDGKTNQEAFYKYIKNMLSKTEGADYFLDKIDREDFLRKQRTFDNGSVPHQIHLQEMHAILRRQGEYYPFLKENQDKIEKILTFRIPYYVGPLARKGSRFAWAEYKADKKVTPWNFDDILDKEKSAEEFITRMTLNDLYLPEEKVLPKHSLVYETFNVYNELTKVKYVNEQGKAIFFDANMKQEIFDHVFKENRKVTKDKLLNYLNKEFEEFRIVNLTGLDKENKAFNSSLGTYHDLRKILDKSFLDDKVNEKIIEDIIQTLTLFEDREMIRQRLQKYSDIFTTQQLKKLERRHYTGWGRLSAKLINGIRDKQSNKTILGYLIDDGYSNRNFMQLINDDSLPFKEEIARAQVIGETDDLNQLVSDIAGSPAIKKGILQSLKIVDELVKVMGHNPANIVIEMARENQTTAKGRRSSQQRYKRLEEAIKNLDHDLNHKILKEHPTDNQALQNDRLFLYYLQNGRDMYTEDPLDINRLSDYDIDHIIPQSFIKDDSIDNKVLVSSAKNRGKSDNVPSEDVVNRMRPFWNKLLSCGLISQRKYSNLTKKELKPDDKAGFIKRQLVETRQITKHVAQILDARFNTKRDENKKVIRDVKIITLKSNLVSQFRKDFKFYKVREINDYHHAHDAYLNAVIGKALLDVYPQLEPEFVYGEYPHFHGYKENKATAKKFFYSNIMNFFKKDDIRTDENGEIVWKKDEHISNIKRVLSYPQVNIVKKVEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 864 - protein, 1338 aa, Artificial Sequence
  Cas9
MRDYYIGLDLGTGSLGWAVTDREYEIMRAHGKALWGVRLFDSANTAEERRGFRTARRRLDRRNWRIELLQELFGEDIGKVDSGFFLRMKESKYMPEDKRDVNGNCPKLPYALFVEDGYTDKDYHRQFPTIYHLRKWLMETEETPDIRLVYLALHHMMKHRGHFLFSGNIEKIKEFQETFRQYIGKIREEELDFHLCIEGEELRETENILKDKNLTRSAKKTRLIKLLGAHTACEKAALNLVAGGTVKLSDIFGNSELDACEKPKLSFADAGYDDYAGMIEDELGEQHVIIETAKAVYDWSVLADILGDYRCISEAKAAVYEKHQKDLRHLKELVKENLGRDVYKEVFVKTNEKLPNYSAYIGMTKKNGVKSEMEGKRCDRKAFYDYLKKTVVNAIPDESKTEYLRKEMETETFLPRQVTKDNGVIPHQVHLQELDAILENLSGRIPALKENGSKIRDIFTFRIPYYVGPLNGIVKGGERTNWVRRKKAGRICPWNFDEMVDTGASAEEFIRRMTSKCTYLIHEDVLPKNSMLYSKFMVLNELNNVRLNGEPISVELKQKTYEDLFQRHRKVTRRRLTDYIRREGIAGRDADITGIDGDFKGSLTAYHDFKEKLTGCELSQADKENIILNITLFGEDKALLKKRLGALYPALTEPQKKAICALSYKGWGRLSQRLLEGITAPAPETGEIWTVIRAMWETNDNLMQVLSEKYCFAAAIDEENAGEELKEITYKTVEQMNVSPAVRRQIWQSLQVIKEICKVMGGPPKRVFVEMAREKMESKRTESRKKRLIDLYKKCREEERDWIEELGNTEETRLRSDKLYLYYTQKGRCMYSGEVIELEELWDNRKYDIDHIYPQSKVMDDSLDNRVLVKKEYNADKTDEYPIRADIRGKMRAFWRILREEGFISKEKYNRLTRGTGFEPSELAGFIARQLVETRQGTKAVASVLKQVFPETDIVYAKARVASQFRQEFDLIKVREMNDLHHAKDAYVNIVVGNVYYTKFTSNAAWYVKEHPGRSYNLKKMFTSERDVARNGETAWRAGNSGTIATVKRVMGKNNILVTRRSYEVKGGLFDQQLMKKGKGQVPIKGRDERLADIDKYGGYNKAAGTYFMLAESEDKKGAKIRSVEYVPLYLCNCIEKDEEAAKKYLQKERGLKNPRVLIAKIKIDTLFKVDGFYMWLSGRTGNQLIFKGANQLILSEPDMRILKKVLKYVNRKKENKNAVLGEHDQLPETDLIRLYDVFLDKIENTVYHVRLSAQQGTLTKNKDTFCELSNEDKCIVLSEILHMFQCQSGSANLKLIKGPGSAGILVLNNIISKCNQVSIIHQSPTGIYEQEIDLKKI

SEQ ID NO: 865 - protein, 1339 aa, Artificial Sequence
  Cas9
MNKAYTLGLDIGTNSVGWAVVTDDYRLMAKKMPVHSKMEKKKIKKNFWGARLFDEGQTAEERRNKRATRRRLRRRKYRILELQKIFSEEILKKDSHFFARLDESFLIPEDKQYARFPIFPTLLEEKAYYQNYPTIYHLRQKLADSTEKADIRLVYLALAHMIKYRGHFLFEGELDTENTSVEETFKEFIDIYNEQFEEGIIFYKDIPLILTDKLSKSKKVEKILQYYPKEKTTGCLAQFLKLIVGNQGNFKQAFHLDEEVKIQISKETYEEDLEKLLRKSNEEMIDVFLQVKKVYDAILLSDILSTKMKDTKAKLSAGMIERYQNHKKDLEELKQFVRAHLHEKVTVFFKDSSKDGYAGYIDGKTTQADFYKFLKKELTGVPGSEPMLAKIDQENFLLKQRTPTNGVIPHQVHLTEFKAIIDQQKQYYPFLEKSKEKMIQLLTFRIPYYVGPLAQDKETSSFAWLERKTTEKIKPWNAKDVIDYGASATKFIQRMINYDTYLPTEKVLPKYSMLYQKYTIFNELTKVAYKDDRGIKHQFSSEEKLRIFQELFKKQRRVTKKKLQHFLSANYNIEDAEILGVDKVFNSSYATYHDFLELAKPYTEKIIELLEQPEMEEMFEDIVKIITIFEDREMVRTQLKKYQRILGEEIFKKLVKKKYTGWGRLSKRLINGIRDQKTNKTILDYLINDDDFPYNRNRNFMQLINDDHLSFKEEIAKELTLSDKQSLLEVVEAIPGSPAIKKGIWQTLKIVEELIAIIGYKPKNIVIEMARENQTTTGGKNRSKPRLKSLEEALKNFDSQLLKERPVDNQSLQKDRLYLYYLQNGKDMYTGESLDIDRLSEYDIDHIIPRSFIVDHSLDNKVLVSSKENRLKKDDVPDSKVVKRMKAYWEKLLRANLISERKFSYLTKLELTDDDKARFIQRQLVETRQITKHVAAILHQYFNQTQELEKEKDIRIITLKSSLVSQFRQVFGIHKVREINHHHHAHDAYLNAVVALALLKKYPRLAPEFVYGSFAKFHLVKENKATAKKEFYSNILKFFEKEEQFCDENGEIFWDKRKHIQQIKKVISSHQVNIVKKVEVQTGSFYKETVNTKEKPDKLIKRKNNWDVTKYGGFGSPVVAYAVVFTYEKGKNHKKAKAIEGITIMEQALFEKDPISFLIEKGYSNVNQFIKLPKYTLFELANGQRRMLASHQELQKANSFILPEKLVTLLYHANHYDEIAYKDSYDYVNEHFSNFQDILDKVIIFAEKYTSAPQKLNQIIATYEKNQEADRKIMAHSFVNLMQFNALGAPADFKFFDTTITRKRYTSLTEIWQSTIIYQSVTGLYETRRRMADLWDGVQ

SEQ ID NO: 866 - protein, 1339 aa, Artificial Sequence
  Cas9
MERYHIGLDIGTSSIGWAVIGDDFKIKKKKGKNLIGTRLFNEGATAAERRGFRTQRRRLNRRKWRLKLLEEIFDPYMAEVDEYFFARLKSSNLSPKDSNKKYLGSLLFPDKSDSNFYDKYPTIYHLRRDLMEKDEKFDLREIYLAIHHIVKYRGNFLEKVPAKNYKNSGASIGFLLEEVNSLYKDIIGDESIAILNSEKFEDVEKIILDEETRNLDKQKSVGKLLVEDKKKKNIVTAFSKAIFGYKFNIEDLLLIENDEKNKLTFNDENIDDIFNELSHSLDDKQMDLLTKTREIYFKFKLNMIVPTGYTLSESMIEKYEMHKAHLKMYKEFINTLNTKDRKILKNAYSDYINTEKAKAANAQENFYKTVKKIIKDNNSDTAKKIIVLIDEGNFMPKQRTGENGVIPHQLHQIELDRIIENQAKYYPWLAEANPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKFKVLNELNNIKVNEKKLDIEQKQDIYLNLFTTAKNVTKKSLATYLNCSADSISGLSDGEKFNSSLSSYIDLKAILGNIVDDCNKNEDLEKIIEYSTVFEDGNIYKEKLSEISWLTDEQIEKLSNIHFKGWGRLSKKLLTQITNENGERIIDALWNTSNNFMQIINDESIQAKLAEINGKYAGKSDLEDILSEAYTSPQNKKAIRQVMKVVEDIEKAMQCEPTSISIEFTRKKQKSRLTNTRYKKISDVYEKIADEVISEYELRKLQSELDSNANNMRDRYYLYFMQLGRDMYTGEKINIDELHQRYDIDHILPQSFIKDDSINNRVLTRKDVNNKEKSDKTAADLYAVEMSDFWRKLRKQGLITEQKYKNLLTKSDSIDKYAKKGFIKRQLVETSQVVKLVANILQDKYSDTKIIEVRAKLNSNLREEYKLIKNRAVNDYHHAIDGYLTTFIGQYLYKTYPKLRSYFVYNDFKKLDSNYLKHMKKFNFLWQLQDDKTIDIYDNVNNKFVLNVPEMKKYIQKIYNYKYMLVSKEVTTKNGAFYDQTKYNAKTVNLIPIKKNKPTNIYGGYKGKVSSYMMLVKIRKKKEVIYKFVGVPRLWTDELDRLKDTTERKILLNEIAKNSLSKTEQDFEVILDKVYYGQLIIDGNQKYTLGSSEYKYNAMQLHLSKHALEVLAKENVKDAEITDKDLVSVYEEILSVVNKYFELYDINKFRQKLNEGLEIFRKLPVYNVYESNKIKQVGKFEVLNRILMGLHANAMITDLKVLGIKTKLGQMQVNGGIKLSPDAKLIYQSPTGIFSRAVRVKDLG

SEQ ID NO: 867 - protein, 1339 aa, Artificial Sequence
  Cas9
MSLNTNKKYNIGLDIGTTSVGWAVTDADGQKLLKAKNKNLWGVSLFEAGKTAAERRGYRSTRRRLNHRKFRLRLLEDMFEKEILSKDPSFFIRLKEAFLSPKDEQKQFKGNILFNDKDYTDADYYEQYKTIYHLRYDLISQHRQFDIREVYLAIHHLIKYRGHFIYEDQTFTTDGNQLQHHIKAIITMINSILNRIIIPETIDINVFEKTLLDRTMNRSSKVKFLIELTGEDKQDKPLLKELFNLIVGLKAKPASIFEQENLATIVETMNMSTEQVQLDLLTLADVLADEEYDLLLTAQKIYSAIILDESMDGYEYFAEAKKESYRKHQEELVLVKKMLKSNAITNDERAKFEYFYTDYIGAKSSNYEESKIIKKGLSAAYGKYSKEERLFKHIELLLAKENVLTTVEHDLLEKNITFASLLPLQRSSRNAVIPYQVHEKELVAILENQATYYPFLLEQKDNIHKLLTFRIPYYVGPLADQKDSEFAWMVRKQAGKITPFNFEEMVDIDASSEAFIKRMTNKCTYLIHEDVIPKHSFSYAKFEVLNELNKIRLDGKPIDIPLKKRIFEGLFLEKTKVTHTSLKKWLAEYEHMTVSVVQGTQKETEFATSLQAFHRFVKIFDRETVSNPANEEMFEKIIYWSTVFEDKKIMRRKLSEYPQLTEQQQVQLAQVRFRGWGRLSQRLINRIKTPVSGDEDHKLSINEILWQTNENFMQIIRNKDYLFKKIIEEQFENETALLNKQRIDELATSPANKKGIWQAIKIVKELEKVLQQPAENIFIEFARSDEESKRSTPRDKFIEKAYAQLKKETDTFNLEHLKELKQRSKQLSSQRLFLYFIQNGKCMYSGEHLDIERLDSYEVDHILPQSYIKDNSIENLALVKKVENQRKKDSLLLNSSIINQNYSRWEQLKNAGLIGEKKFRNLTRTKITDRDKEGFIARQLVETRQITKHVTQLLQQEYKDTTKVFAIKATLVSDLRRKFEFIKNRNVNDYHHAQDAFLVAFLGTNITSNYPKIEMEYLFKGYQHYLNEVGKSAAKPKFTFIVENLSKQQYNSTTGEVKWNPEVDIAKLKRILNFKQCNIVRKVEEQSGALFKETIYPVEESSSKTIPLKKHLDTAIYGGYTAVNYASYALIQFKKGRKLKREIIGIPLAVQTRIDNSETSLQTYIAEQIKSEVEILNGRILKYQLISNNGNRLYIAGPRERHNARQLIVSDEAAKVIWLISTKQAVEATFLKHYTLEHLEAVFEELIRKQAADYQIFENLIKKIEVNKAYFYSCTYNEKVKVIEELLKITQANATNGDLKLLKMTNREGRLGSVSVALDFKIINQSVTGLYQSIEDYNN

SEQ ID NO: 868 - protein, 1339 aa, Artificial Sequence
  Cas9
MSLNTNKKYNIGLDIGTTSVGWAVTDADGQKLLKAKNKNLWGVSLFEAGKTAAERRGYRSTRRRLNHRKFRLRLLEDMFEKEILSKDPSFFIRLKEAFLSPKDEQKQFKGNILFNDKDYTDADYYEQYKTIYHLRYDLISQHRQFDIREVYLAIHHLIKYRGHFIYEDQTFTTDGNQLQHHIKAIITMINSILNRIIIPETIDINVFEKTLLDRTMNRSSKVKFLIELTGEDKQDKPLLKELFNLIVGLKAKPASIFEQENLATIVETMNMSTEQVQLDLLTLADVLADEEYDLLLTAQKIYSAIILDESMDGYEYFAEAKKESYRKHQEELVLVKKMLKSNAITNDERAKFEYFYTDYIGAKSSNYEESKIIKKGLSAAYGKYSKEERLFKHIELLLAKENVLTTVEHDLLEKNITFASLLPLQRSSRNAVIPYQVHEKELVAILENQATYYPFLLEQKDNIHKLLTFRIPYYVGPLADQKDSEFAWMVRKQAGKITPFNFEEMVDIDASSEAFIKRMTNKCTYLIHEDVIPKHSFSYAKFEVLNELNKIRLDGKPIDIPLKKRIFEGLFLEKTKVTHTSLKKWLAEHEHMTVSVVQGTQKETEFATSLQAFHRFVKIFDRETVSNPANEEMFEKIIYWSTVFEDKKIMRRKLSEYPQLTEQQQVQLAQVRFRGWGRLSQRLINRIKTPVSGDEDHKLSINEILWQTNENFMQIIRNKDYLFKKIIEEQFENETALLNKQRIDELATSPANKKGIWQAIKIVKELEKVLQQPAENIFIEFARSDEESKRSTPRDKFIEKAYAQLKKETDTFNLEHLKELKQRSKQLSSQRLFLYFIQNGKCMYSGEHLDIERLDSYEVDHILPQSYIKDNSIENLALVKKVENQRKKDSLLLNSSIINQNYSRWEQLKNAGLIGEKKFRNLTRTKITDRDKEGFIARQLVETRQITKHVTQLLQQEYKDTTKVFAIKATLVSDLRRKFEFIKNRNVNDYHHAQDAFLVAFLGTNITSNYPKIEMEYLFKGYQHYLNEVGKSAAKPKFTFIVENLSKQQYNSTTGEVKWNPEVDIAKLKRILNFKQCNIVRKVEEQSGALFKETIYSVEESSSKTIPLKKHLDTAIYGGYTAVNYASYALIQFKKGRKLKREIIGIPLAVQTRIDNSETSLQTYIAEQIKSEVEILNGRILKYQLISNNGNRLYIAGPRERHNARQLIVSDEAAKVIWLISTKQAVEATFLKHYTLEHLEAVFEELIRKQAADYQIFENLIKKIEVNKAYFYSCTYNEKVKVIEELLKITQANATNGDLKLLKMTNREGRLGSVSVALDFKIINQSVTGLYQSIEDYNN

SEQ ID NO: 869 - protein, 1339 aa, Artificial Sequence
  Cas9
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 870 - protein, 1340 aa, Artificial Sequence
  Cas9
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 871 - protein, 1340 aa, Artificial Sequence
  Cas9
MKTDYFMGLDMGTGSLGWAVTDSSYHLCRAHGKDLWGVRLFETAQTAEERRVFRCNRRRLDRRKRRIQLLQDIFAPEIYKIDPGFFLRLKESRYLPEDKKNLEGKTPELPYALFVDKKYTDKDFHKEYPTIYHLRLRLMQDRTPADVRLVYLALHHLIKHRGHFLFAGIEADKVTDFSAAFSEFLRIVQEQELDISFTPDEESSQIIKETLQNTNFTRSKKSTELIKGLKASTGCEKALLKLISGCKVKLSAVFDDPGCDAYEKPQVCFAESSYEDYAAILEDELEDRFIVIAAAKALYDWSVLVNILGEASTVSEAKVGIYEKHRRDLKYLKHLVKTNLTREDYQDLFVKAGAKKNNYCAYIGMTKKNNKKVVLEEKRCTKEDFYAYLKKEIYSKVQENPEAEYLLEELEKGTFLPRQVSKDNGVIPYQLQFLELQKILKNAVEYLPFLKEESEKIQQIMTFRIPYYVGPLNGKKEGQNTFAWAVRKNNEPVYPWNFEEVIDTEASAEQFIRRMTNKCTYLPGEDVLPKESLLYSKFMVLNELNNLRINGTKISVELKQELYEKLFQRYRKVSAKKLRDYLVRNGITEKDAEISGIDGDFKGTLRAYHDFKEKLTGVELTEAEKETIILNITLFGEDKVLLKKRMQRLLPNLTEGQKKAIVTLNYSGWGRLSREFLEEVQAPNPESGEILSIIRALWETNANLMQLLSNQYGYQEILEQMRADWTGHKLDYQTVEELYVSPAVKRQIWQTLQVVKELKKVMGGEPKRVFLEVAREKMESGRTVSRKKHLKDLYLSCKSEERNWLAELDRHEEHSYRSDRLFLYYTQKGRCMYCGKPIDLGHLWDVNMYDIDHIYPQSKVMDDSIRNRVLTCRTCNAEKTDHYPLKAEIRQKMRPFWDSLKAGNFIEEEKWKRLIRSEEFTSTELAGFIERQLVETRQSTKAVADILKQAMPETEIVYVKAKNVSAFRQDFNFVKNRDVNDFHHAKDAYLNIVVGNTYFVKFTKNASWFIERNPGRSYNLKRMFTSDYDVMSNGEIAWKAGNSGTITTVRKMMKKNSVLFTRRSFEVSGGLFDQQLMKKGKGQVYVKSGDERLRSIEKYGGYNKATGAYFMLVESEGKKGVKKRTIEFVPLYRKAELEASEEKMLEYLRTEIGLKEPHVLLHKIKTDTLFQADGFKMHLSGRTGKQLVFKGANQFLVAEDYERLLKKVGKVTEQLKTNKNYKINDYDGITEEGLKALYSEFLSKLQKAPYGNRLGTQAETLENGKEKFDKLSLENKCQVLSEILHLFQCNSSAADLSKLGGPGHGGILVLSNEITKCNKISIIHQSPAGIYEQEIDLKTL

SEQ ID NO: 872 - protein, 1340 aa, Artificial Sequence
  Cas9
MEQEYYLGLDMGTGSVGWAVTDSEYHVLRKHGKALWGVRLFESASTAEERRMFRTSRRRLDRRNWRIEILQEIFAEEISKKDPGFFLRMKESKYYPEDKRDINGNCPELPYALFVDDDFTDKDYHKKFPTIYHLRKMLMNTEETPDIRLVYLAIHHMMKHRGHFLLSGDINEIKEFGTTFSKLLENIKNEELDWNLELGKEEYAVVESILKDNMLNRSTKKTRLIKALKAKSICEKAVLNLLAGGTVKLSDIFGLEELNETERPKISFADNGYDDYIGEVENELGEQFYIIETAKAVYDWAVLVEILGKYTSISEAKVATYEKHKSDLQFLKKIVRKYLTKEEYKDIFVSTSDKLKNYSAYIGMTKINGKKVDLQSKRCSKEEFYDFIKKNVLKKLEGQPEYEYLKEELERETFLPKQVNRDNGVIPYQIHLYELKKILGNLRDKIDLIKENEDKLVQLFEFRIPYYVGPLNKIDDGKEGKFTWAVRKSNEKIYPWNFENVVDIEASAEKFIRRMTNKCTYLMGEDVLPKDSLLYSKYMVLNELNNVKLDGEKLSVELKQRLYTDVFCKYRKVTVKKIKNYLKCEGIISGNVEITGIDGDFKASLTAYHDFKEILTGTELAKKDKENIITNIVLFGDDKKLLKKRLNRLYPQITPNQLKKICALSYTGWGRFSKKFLEEITAPDPETGEVWNIITALWESNNNLMQLLSNEYRFMEEVETYNMGKQTKTLSYETVENMYVSPSVKRQIWQTLKIVKELEKVMKESPKRVFIEMAREKQESKRTESRKKQLIDLYKACKNEEKDWVKELGDQEEQKLRSDKLYLYYTQKGRCMYSGEVIELKDLWDNTKYDIDHIYPQSKTMDDSLNNRVLVKKKYNATKSDKYPLNENIRHERKGFWKSLLDGGFISKEKYERLIRNTELSPEELAGFIERQIVETRQSTKAVAEILKQVFPESEIVYVKAGTVSRFRKDFELLKVREVNDLHHAKDAYLNIVVGNSYYVKFTKNASWFIKENPGRTYNLKKMFTSGWNIERNGEVAWEVGKKGTIVTVKQIMNKNNILVTRQVHEAKGGLFDQQIMKKGKGQIAIKETDERLASIEKYGGYNKAAGAYFMLVESKDKKGKTIRTIEFIPLYLKNKIESDESIALNFLEKGRGLKEPKILLKKIKIDTLFDVDGFKMWLSGRTGDRLLFKCANQLILDEKIIVTMKKIVKFIQRRQENRELKLSDKDGIDNEVLMEIYNTFVDKLENTVYRIRLSEQAKTLIDKQKEFERLSLEDKSSTLFEILHIFQCQSSAANLKMIGGPGKAGILVMNNNISKCNKISIINQSPTGIFENEIDLLKI

SEQ ID NO: 873 - protein, 1340 aa, Artificial Sequence
  Cas9
MGEEYFLGLDMGTGSLGWAVTDDKYQILRRHGNALWGVRLFETANTAEERRMFRTNRRRLDRQGWRIKILQELFAEEICRVDPGFYLRMKESKYYPEDKRDANGECPALPYALFADAQYTDKDYHREFPTIYHLRKMLMETETTPDIRLVYLAFHHMMKHRGHFLLSGDISQVTEFRNTFLQMIANIKSEELDFSLEIEETQMGQIEAVLKDHKLTRSEKKRRLTQILKPATACEKAIFTLLSGGTVKLSDIFGKAELDEGERPKISFADNGYDDYSASVEADLGEQYYIIESAKAVYDWSVLSDILGDSVSISDAKVKLYEKHKKDLAYLKKVVRENLPREVYNQVFVNTDEKLCNYCAYIGMAKKNGRKVALEGKRCTREEFESFLRKKIVNKIEDKEIQEYLSEEIEKGTFLPRQVTKDNGVIPYQIHLYELRKIIDNLSPRMPFIRDNGDKIIQLFTFRIPYYVGPLGKGEGSEKFSWAVRRTDEAIYPWNFKDVIDVEASAEKFICRMTNKCTYLYGEDVLPKDSPLYSKFMVLNELNNLKLDGQSVSVELKQRIYQELFCHTRKVTQKKLVSYLVREGITGKNVEISGIDGDFKASLTAYHDFKEKLTGVELSQQEQEEIVRNIVLFGEDKKLLKQRLEGRFPQLTQKQISVIATLSYKGWGRLSREFLENITVPAPGTGEVWNIITALWETNDNLMQLLYGEYGFQTEIECFNAKEKKKSLSYETIEESYVSPSVKRQIWQTLQVVKELKKVMRGDPKRVFIEMARENQESKRTESRKKTLLDLYKNCKKEEPEWIAELTEHLEKLDDSQLRKDKLFLYYTQKGRCMYSGERIELEDLWDNTRYDIDHIYPQSKTMDDSVDNRVLVKKEYNAKKTDVYPIAADIRGKMSPFWKKLLDNKLISKKKYDRLVRTEELTPEELAGFIDRQLVETRQSTKVVAEILKEAFPDTEIVYVKAGNVSNFRHMFDIVKVRELNDLHHAKDAYLNIVVGNAYYVKFNKNAAWFIKENPGRSYNLKRMFDYDIRRNNEVAWLAGSTGTISQVKNMVSKNHILVTRKSYEVTGGLFDQQLMKKGKGQVPVKTSDERLGNIEKYGGYNKASGAYFMLVKSKNKKGEEQRTIEYVPIYLKHYIEESKENALDYLKNERKLNEPEILLDKIKKDTLFRVNGFYMCLSKRTGKQLAFKGANELLLPEPETLLLKKITKYIQRRKENKDLKLTKQDNITEKELLELYDVFTEKLNHSVYAVCLGTQGKTLVQKKPAFVALPVEEKCIVLSEILHLFQCQSGSANLKLIGGPASAGILYLNSNISDAGEILIINQSPSGIFEKRIDLLRL

SEQ ID NO: 874 - protein, 1340 aa, Artificial Sequence
  Cas9
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 875 - protein, 1340 aa, Artificial Sequence
  Cas9
MEQEYYLGLDMGTGSVGWAVTDSEYHVLRKHGKALWGVRLFESASTAEERRMFRTSRRRLDRRNWRIEILQEIFAEEISKKDPGFFLRMKESKYYPEDKRDINGNCPELPYALFVDDDFTDKDYHKKFPTIYHLRKMLMNTEETPDIRLVYLAIHHMMKHRGHFLLSGDINEIKEFGTTFSKLLENIKNEELDWNLELGKEEYAVVESILKDNMLNRSTKKTRLIKALKAKSICEKAVLNLLAGGTVKLSDIFGLEELNETERPKISFADNGYDDYIGEVENELGEQFYIIETAKAVYDWAVLVEILGKYTSISEAKVATYEKHKSDLQFLKKIVRKYLTKEEYKDIFVSTSDKLKNYSAYIGMTKINGKKVDLQSKRCSKEEFYDFIKKNVLKKLEGQPEYEYLKEELERETFLPKQVNRDNGVIPYQIHLYELKKILGNLRDKIDLIKENEDKLVQLFEFRIPYYVGPLNKIDDGKEGKFTWAVRKSNEKIYPWNFENVVDIEASAEKFIRRMTNKCTYLMGEDVLPKDSLLYSKYMVLNELNNVKLDGEKLSVELKQRLYTDVFCKYRKVTVKKIKNYLKCEGIISGNVEITGIDGDFKASLTAYHDFKEILTGTELAKKDKENIITNIVLFGDDKKLLKKRLNRLYPQITPNQLKKICALSYTGWGRFSKKFLEEITAPDPETGEVWNIITALWESNNNLMQLLSNEYRFMEEVETYNMGKQTKTLSYETVENMYVSPSVKRQIWQTLKIVKELEKVMKESPKRVFIEMAREKQESKRTESRKKQLIDLYKACKNEEKDWVKELGDQEEQKLRSDKLYLYYTQKGRCMYSGEVIELKDLWDNTKYDIDHIYPQSKTMDDSLNNRVLVKKKYNAIKSDKYPLNENIRHERKGFWKSLLDGGFISKEKYERLIRNTELSPEELAGFIERQIVETRQSTKAVAEILKQVFPESEIVYVKAGTVSRFRKDFELLKVREVNDLHHAKDAYLNIVVGNSYYVKFTKNASWFIKENPGRTYNLKKMFTSGWNIERNGEVAWEVGKKGTIVTVKQIMNKNNILVTRQVHEAKGGLFDQQIMKKGKGQIAIKETDERLASIEKYGGYNKAAGAYFMLVESKDKKGKTIRTIEFIPLYLKNKIESDESIALNFLEKGRGLKEPKILLKKIKIDTLFDVDGFKMWLSGRTGDRLLFKCANQLILDEKIIVTMKKIVKFIQRRQENRELKLSDKDGIDNEVLMEIYNTFVDKLENTVYRIRLSEQAKTLIDRQKEFERLSLEDKSSTLFEILHIFQCQSSAANLKMIGGPGKAGILVMNNNISKCNKISIINQSPTGIFENEIDLLKI

SEQ ID NO: 876 - protein, 1341 aa, Artificial Sequence
  Cas9
MRFQNKKTGDYFVGLDIGTNSVGWAVTNEKYEILRAKNHRMWGSRLFEEGKTAEERRVHRAGRRRLNRRNDRLMILEDLFAEEISKVDKAFYQRLHESQYRQEHKTVSGPYFLFNDKEFTDEDYHIDYPTIYHLRVALMKAPAKDVRLLFLAIHHIIKYRGNFLHEGETFKTTGGLTDILQRVLACNEFSGLKQHIDDTALVKLLTNKGITRSDIAKQISELATDKLYRKQAKAFASLVLGLKANLDDLFNEPEYKELDSEIRTVEFSGKEYWEERDKYEPYLGESLFALDGCKTLYDTLLLSNIKPDGKYLSEAKVETFEKHHEHLESLKDLLKSNKALYNRVLRDDEKNLNNYITYIGKSEFNKRCSRDEFYKFLKQTIKDISDNENKAEIVQLMELDSFLPLLRVRENGVIPYQIHEEELEQILNVSSEKYPFLNKADGSGFTIAQKILKLLTFRIPYFVGPLNPAHKDRDNGFAWVVRKAPGKVYPWNFEDKVDISASATAFIENLTNKCTYLIGEDVLPKYSLAYSKFSLLNELNNLRYDGKPLSYETKQSFIKDCFEKEHRKMTEKRIREFLKHLGGTDGKGALTGLDVDIKSDLKSYRDMVRILGDGFDETMAERIIRYVTLFGEAKKVLLSTLEIEFGDDLSDTQKKQILKLQYRDWGRLSATLLKGIKGVAGDNPECSILECMEQQPLNLMEVLSSHNTYLAAIEEFNKERTEPTDIVDYKLVDDLYISPAVKRSVWQTLRILDEITKLRGSVPKKVFVEVARTNRAEKKKTDSRKERLLQLYKTIKDEGRNWTEEIKQRDAGDFNSKKLFLYYTQQGRCMYSGEKITSIGDLFTSKYDIDHIYPRSVTKDNSWDNLVLVKAELNREKKDIYPIEKDTQDRCISLWKQLLEQGLISERKYERLVRTTPLTADELADFVNRQLVETNQSVKAVTNLLKRLYPDTTICYVKAENVSDFRQEREFVKLRSLNAHHHAKDAYLNIVVGNVYHEKFTNNPRNFIKNARSDKKRPYSLNHMFDYLLQVGNKEIWNPKTDNNLVKKMMRNNDVQVTRMLVEQTGALYDATIYKASVTKSESYVPLKSSDAILSDVKKYGGFTSIKIAYYSIFRFYKKNSEEFETHIISIPVLKAGTLNSKEDYVAYGEEIMNKQKFDRVELVYKKLCMNSLVRINGVMYYLGGKTNNSLYIDSAISLVLPDNIAKKIKAVEKYIARVAENGNYKPQPDQVSPEFNMIIYKALTEKMKQPAFVGLKTNRENELEKETTITAFIAMTLIEQCKMLMEILNLLTQQKTTYALKPIGVSASRSTLGMNITGLSEFTIITQSVTGLQEKEIRII

SEQ ID NO: 877 - protein, 1341 aa, Artificial Sequence
  Cas9
MWGSRLFEEASTAQDRREHRSNRRRLERRKYRLDLLEELFVEEINKIDPEFFIRLRESKFHFEDRSLKNTFILFNDKMEGGYNDKVFFSKYPTIYHLRSALINGNKEDVRAVFLAIHNILKNRGHFLLAGNDINISLSLNDTLTDLFEYLKIHLGIEVEFENKLKDIEKIALDKNLSKSDKQKKIVQLLETDYKKQLADVFKLSLGLTANMENIFGKENEQGLEFINAENKIKKIQFDSSYEENIAEFDQFYGEYFEIIDICKKIYDAISLSQILVDGKGLSESKVLSYEKHKEDLKLLKKVLKNIDKAYDNKGEDRLVYKVLKEDKDKGTNYVNYSKLSNNGTATTKEEFYKFLSKNLDLKKFGKLNKEDIETLDYINSEILLGRFLPLQKEKINGVIPYQLQMKELTQILNNASKYLPFLNKIEDGMTVKDKIISLIKFRIPYYVGPLNEYNRIENGNGFAWIEKKKNEKIFPWNFNDVVDIEKSAEKFINNLTNKCTYIKEETVLPKNSIIYSKFMVLNELNNLQYGNKKLDIELKMKMYTDLFLEKKDNRKVTEKRILEYFRINGINDGKEKLTGLNNEIHADMKSYRDMCEIMGENFNINVAENIINWITVFHGEKKILINKIKNVYGKMFNDEQISKLSKLNYSDWGRLSKKLLTDIKCYIDADGINFPVSILEAMEVSNKNLMELLSNKYEFISCIDDINNKYFGDRDISASELIDELYVSPAVKRGIWQSVRILEEIVSIIGHNPKKIFIEMTRHNEEKVQKSSRRHNLEELYKAIRKDPEYVELIKEFDSTTDTDSFKIKKLYLYFMQLGKCAYSKEKIDFDKLFTDSYDIDHIYPRSKTKDDSIHNNLVLVKAKYNREKTDVYPIDINIQKNMNSFWNFLYTKKFITEEKYKRLIRTSDLTDEELAKFISRQLVETSQSTKATAEVLKQIYGDSDICYVKAENVSDFRYGSSRQKDKNDIQKLFVKCREVNHFHHAKDAYLNIVVGNVYDVKFTKNPVNFIKKNKMGNKSNYSLNHMFCFDVERNGYKAWDSSETIKTVGRMMKSNDVRITKHVHPTRGELYDATIYKAKIAKTGSYMPLKSSKNTPLSDVTKYGGYTKIKIAYYSVYKYKFSDKNLIKTEIRLIPIPIYLSKNDDDIKEYVKNYLNDRVNSKLIDFTKIYDKLYVNSLIKINGYLYYLGGKTNDRVWIDNAVSIVLDDKIEYLIKRISNDIKYGYEINVSDDELMDIYESLAEKANKKIFYNRLSDFEKIFSNMDVKKKFVKLEKNDKCRVLLQLLNVLTDSQTTYKLEMVGLKHSRSNIGMKISNLEEFKVINSSITGLYSNEIDILNI

SEQ ID NO: 878 - protein, 1341 aa, Artificial Sequence
  Cas9
MEKDYYLGLDMGSGSAGWAVTDDQYHVLRAHGKAMWGTRLFESANTAEERRINRTARRRLKRRNQRIEWLQEIFAEEINTKDSGFFRRMKESRYWAEDKRDENGSCPEMPYSLFIDEDFTDKEYHEKFPTIYHLRKYLMTTEETPGIRLVYLAFHHMMKHRGHFLLNGNIEEIRKFRKTFDQFLEVVRNEEMGFAGEIEEETYKKIEMTLKDVNLTRSAKKTTLIKSLKVTRVEEKELLALISGCTVKLSNIFNDKSLDETERPKISFADAGFDDYEAEIQSNLNEKYYIIESAKAVYDWAALADILGEYSCISEAKVALYEKHHKDLKRLKDLVRNNISSEVYKEIFVDVSGKYKNYCAYIGTTNINGKKKDFEGKKCTKEDFYAYLKKSVIECINDSEKTDWLKLELEKGNFLPKQLTGENSVIPYQVHLYELNAIITNLQERIPLLKRDGEKIRQIFTFRVPYYVGPLNGISIDGKKTNWVKRKEGVIYPWNFSDIVDEESSAESFIRRMTNKCTYLIHEDVLPKYSLLYSRFEVLNELNNVRLNGELLSVELKQKIYEDVFQRYRKVTQKRLKRYLLTEGIIDENTVITGLDGDFKGSLTAYHDFKEKLTGLNLTEREKEEIILNITLFGDARSLLRKRIGKICSQLSDKQKENLSKLSYQGWGRLSKKFLNGIAISVQGEEEWTIIKALWETQDNLSQLMGAKYTFRNAVEKENGELENREISYETVKDLSISPSVKRQVWQSLLIVKEICKIQKKPPRKVFVEVAKEKTNSGRTESRKKRLQDFYKYCSKYEKELYDESIQNKLEKCSESDLRSDKLFLYYMQMGRCMYTGQPIDFDELWNNQKYDIDHIYPQSKTMDDSIDNRVLVKRISNQEKTDVYPIRADIREKRRGFWKELKNVGLISEEKYKRLTRATEFEPAELAGFISRQLVENRQTTKVVASILKQAMPDTEIVYVKARTVSEFRHKFNFIKVREMNDFHHAKDAYLNVVVGNTYLVKFTKSPVNFIENHSNRSYNLKKMFTDGRVERNGEIAWISGENGTIGTVRNIMKKNNILVTRRAHEATGGFFDQQLMKKGKGQVPVKGSDERLLDIEKYGGYNKETGAYFVLVESDEKKGKKKRTIEYVPIRLKKQLENNRKALENYLCEQRGLTNPVVLIDKIKMDSLFRVDGFFMWLSGRTGNQLLFKCANQLVLSTEDEATLKKIVKFVNRRKENKEIKIYESDKLNEEMLNRLYNTFLYKLQNSIYGNRLGEQAKTLSSKKENFDKLQIEEKCLVLYEILHMFQCQSATSDLQLIEGPGKAGTLRLNSNITKYKNINIINQSPTGIYEQVIDLQKI

SEQ ID NO: 879 - protein, 1341 aa, Artificial Sequence
  Cas9
MGKGYYVGLDMGTGSVGWAVTDESYQILRRHGKAMWGVRLFESAKTAEERRMFRTGRRRLDRRGWRIEILQEIFAEEISRVDPGFFLRMKESKYYPEDKRDIQGNCPELPYTLFVDKTFTDKDFHKKYPTIYHLRKMLMETEDTPDMRLVYLALHHMMKHRGHFLLSGDISQVTEFKNTFNQFIENIRNEEMDFEIELDESAVQMIEETLKDKNLTRSAKKSKLVKGLNAKNVRDKAFLTLLSGGTVKLSDLFGMEELNEGERPKISFADNGYEEYAAVVEMELGELYYIVESAKAVYDWAILSDILGGSTSVSDAKVRAYEKHKADLKYLKAVVKEYFPKEVYNAVFVESSDKLNNYPAYIGMTKKNGKKVSLEGKRCSREEFMDFLKKNIVVKLPDEEAKMYLQSELEKDSFLPKQVNKDNGVIPYQVHKYELKKILDNLGDKIPFLKENAEKIEKLFSFRIPYYVGPLRTGNGENSKFAWAERKSTEKIYPWNFENVIDVEQSAENFIRRMTNKCTYLIGEDVLPKDSLLYSKFMVLNELNNLRLDGQKISVELKQKIYRDVFCRSRKVTQKKLKSYLIREGIAGKNVELTGIDGDFKGSLTAYHDFKEKLIDVELTQKEKEEIILNIVLFGDDKKLLKQRLKKKFPQLTEKQINTVTALSYKGWGRLSKKLLEEVTVPAPETGEVWNIITALWETNDNFMQLLSKEYQFSDRIEEFNEEKADPEVSYQTIEDLYVSPAVKRQIWQTLQIIQEIEKVMGEKPKRVFVEMAREKQENKRTESRKKTLSDLYTKCKKEEPEWIEALCTSLEKHEEHQLRSDKLYLYYTQKGRCMYSGEPIDLEDLWDNTKYDIDHIYPQSKTMDDSLKNRVLVKKEYNAKKSDTYPIAADIQKKMMPFWKSLLTGGFIPKEKYDRLVRNNPLDANELAGFIERQIVETRQSTKAVAEILKKILPDTEIVYVKAKTVSKFRQDFDFIKVRDMNDLHHAKDAYLNIVVGNVYFVKFTKNAAWFVKENPGRTYNLEKMFIWDVARDGEIAWKAGKSGSIVQVRAMMEKNHILVTRRSYEVKGGLFDQQILKKGKGQVPVKESDERLRDIGKYGGYNKAAGVYFMLVSSKDKKGKEQRTIEFVPIYLKDRVEKDMESARNYLMEERGLREPKILIKKIKIDTLFKVDGFYMWLSGRTSNQLIFKGANQLILSKEDMKTLKKVVKYIQRQKEDKNVKISMRDGITEEELLKLYETFLDKIRHSIYGARLSSQEKTLVNGKEKFIDLSVEAKCQVLYEILHLFQCQSGAANLKMIGGPASAGILVMNNNISKCKNISIVNQSPTGIYEKEIDLLRV

SEQ ID NO: 880 - protein, 1341 aa, Artificial Sequence
  Cas9
MTQKVIPYNIGLDIGTNSVGWAVTDNENKLLHIKGHNGIGVRLFKEGQSAAERCGFRTTRRRLSRRKWRLRLLNEIFADKIAKVDPSFFARLKQSNVSPKDPNKTMFGNILFDNGNLNDKSFHDEYKTIYHLRQSIIDHPEKKFDIRLIYLAMHHIIKYRGHFLNQANVQDFKGGKIDLEESFKDLNSIFENQGRDLRLVTEDANKYVKELSDNSKTRNDRQKELSKVLYIPIDKNSDKNNKKVTTEIIKAILGMKAKFDVIFGIDAENAKEWSLTFNSDDFDDKIEGLSAQMTDEAGEILLILKELYFALNLSDILNNSVTDKNAKTLSEAMINRYDDHKEQLTMLKQVIDNSDKKHAKALKAAYSAYIDGENNKKISFEDLRKRIQKNLDNSETSKKINDLLEHDYFLPKQRSKENGAIPHQLQQQELDKIIESQKHYYPFLAELNPNEKRSRQAKYKLDELVAFRVPYYVGPMVKATENNQSNNGKFAWMIKNDNISDKLKKEEITPWNFDKKVDRTETATKFITRMTTTDTYLIGEPVLPKNSLLYQKFVVLNELNNLKINKQPITPEQKQYVYEHVMKQTKRVSLKKIADALVIKGDYPYAPEITGTTDQKNMNNGLSTYIDLAKIFGDELDDIDRKEDFEKIIEWSTIFEDQHIFALKLKEIKWLTEDQRKQVVKLRYQGWGKLSKKLLADLVDDNGQRIIDLLWDSKQDFMQIVNQNSFKQAIAEHNGAHLEEKDLKDIINNLYTSPQNKKAIRQVILVVDDIIRAVGYEPVNIMMEFAREDSKDHRLTNSRSRQLEKVYKDITNSWFDDDNVKDELKDKIKDKAKFTDRLYLYFTQGGKDLYTGEPLDIDNLSNYQIDHILPQSFILDNSLDNRVLTSKINNQIKKDNLPGEFFGSKMHNFWKHLKELHLISNKKYYNLTLTPNSISKFNNQGRFINRQLVETRQVIKLAAEILHNRYSEENGTNIVTVKANLTHHMREKFNFYKNRNVNDYHHAFDAYLAAFVGNWLLQQYPKLKPYFVYGDFAKTEIDNLKSFNLIYKFEQAHQLNEEDGKIAKDTDALLGYMKNVYHFKKMLVTKELETNHGNLFKQTLYPSHGKMKNLINPKENRSSDIYGGYSSETGAYVSLIKVFKKNKIENKIIKIPLLYIDKLNRQANAKQFIRNFIIKDDSNKFDILSEKIFLNQLVIDGDELFTISGSGDRQNAQQLILSDKSLKILSKNINVISKNDLIIIFNEIIDDICKYMKMYEVENSDETKAKFEEINDKDRMLKIINDLLLGLHANASRSNLSSIGLSPSFGRFFSGNAGIKLSENAKFIYQSPTGLFSRKVKISDL

SEQ ID NO: 881 - protein, 1343 aa, Artificial Sequence
  Cas9
MTYYLGLDMGTSSVGWAVTDENYNLIHRHRKDLWGIREFEEAKTAVERRTQRISRRRRQREVARIGLLKDYFHDEIQKVDPNFYQRLDNSKYFPEDKEEVVKGKNGIFADENYTDRDYFAEYPTIFHLRRELLNSKEPHDVRLLYLALLNMYKHRGHFLNTTLGTDGENRKLSDVYRDFVVKTEEVLGLTFPQETDNGKMQEIMCSREFSRKRKAELLCALLEIDKKQKQQVALIECVLGLDKSVKQMYGTAVPDDFDKSVKVNFSDSSFEEKVSEVEELLDEEKYELILCMKELYDTAVLNQIMGDCNYLSEARVQEYEKHKEDLKLLKRTVKKYGTAEEYQFLFRSSEKASYNAYVHSVNSGEKIRRNMDGRSRDDLYTVLKKMLKNYPQEDADCKYILEEIEKEQFLPKQLVSDNGVIPNQIHYKEMKKILENAEQYLHFLREKDESGYTVAERILKLFAFQIPYYIGPTSEKSGKNGGNGWVVRKEQGQVLPWNIEEKIDMKATSETFISRMVRRCTYLSDEMVLPKASLEYESFCVLNELNNLRIRGVKLPITVKQDIYKDLFERGKRVTRKQIVNYLKGVGILQEGEEDELTGMMDTFNSSLASYGKFKSILGEKIQEDSCKRMVEQIIFWCTIYGDAKKFLKEQLEEKYGDVLTREQIKRILGFKLKDWGNLSKKFLELNGCDRNTGEVMSLIRMLWESDDNLMELLKDSSYTYRAELEEQQEKLTKTLTEICPEDLEGYYFSAPVKRMIWQTLLILKEVEKVMGEPPKRVFVEMTREHDERREMKDSRGKKFQELYKNIKDEEHNWKAEIEDAEKDGRIRSKKMYLYLTQRGRCMYTGNPIDLEELFTTKYDIDHIYPRHFVKDDNLDNNLVLVEKEKNAHKSDQYPLGDDIYTGRLSWWKELHREKLINDEKYKRLTGRAPFSDEQKAGFIARQLVETSQGTKGVASILKEVLPETTTIVYAKARNVSDFRNTNELLKARSVNDFHHAQDAYLNIVVGNVYYVKFTNNPLNFVRSGEGYNLDGVFRKNVIRGQENAWIVKPEKGEKMTLETVKRVMAKNTPLLTRLSFEGRGGLANQTLYSAKEAAGEGYVPLKSSDSRLQDVTKYGGFTSVTTAYFILVEHDMKKKRVRTIESVPILWKERIEKESGQLEIYCREALGLVNPDIRVRKILIQSLVKKDGFYMHLSGKTGNRFIMRNAVELCLKQEWINYSKKLEKEGCDESITKEKNEELYEILKEKHINGIYRKRPNPMGEKLHIRQETFRMLTLEEQKKVLLSLLNLTKIGPVEANLELIGESAHTGKMLISKNITEVKEFYLIHQSVTGIYEKQVNLLTV

SEQ ID NO: 882 - protein, 1343 aa, Artificial Sequence
  Cas9
MATKKEYNIGLDIGTTSVGWSVVETDNQKVMRKGNKALWGVRLFEEATTAESRRMQRSTRRRYDRRRERIKLLQEEFSEEINKVDKNFFQKLKESKYVENDKINKKIVLTKEEKQELKDYQNKYKTIYHLRDELINNPEKKDIRLVYLAIHHIIKYRGNFLYQNANFNIDNLDIKDKLNELFSILSNNIQELEIPEDYINIIDFDELEADLLKDTKNDVKALLIDNLTELTNKSSATEFGKLMVGNKGNINKLLMLETDNKIEISFSGTDYDDKYEEYQEALGENIEILDILKQIYDCIFLKKIFKGNKNTSISSLMVKSFEQHKKDLNFLKELFKDNRELYNEIFRTKKDLCLYEKYITNKIDCDEFRKEINKLLESLFSDENIKQNLLDEYNLEVKERIENGTFLPRITTTDNGKYPYQLNKSELIKIIENQGKYYPFLLNKLNDNKTYKIVKLLEFRIPYYVGPLVSEKRSENSWLERKINNVKITPYNFDDVVDKEKTAEKFIKRMISHCTYLLDEYALANNSILYSEFKVMNELKQIRVNDRKLELKFQQQILEDFFKKTSGTITERKFKNYLISTGEYSMEGGNFRITGYSADGKFANNMQSYVDFFGENGIFADTDYNLENAEEIIEWITIFEDKDILEKKVRDNYSKLNENQIKKVLAKKYSGWGSLSKKLLKTKYYKDKATELYKSILDLMYETDKNFMQIINDDKYNFQEMIKKFNNKEENKKLNYSIVEELATSPATKRGIYQALKVVEELVDYIGYEPKNISIEMARSEEEKVRKDSRKDYINNLYKGCKDSIENYKKLKHELDSHEITSQRLFLYFIQEGKCLYTGTPLNIEDIENQSLYEIDHIIPRSLIKDDSIDNKALVLKECNQDKKASYVLPSKFRNSKQKTWWKHLKDNGLMSAKKFHNLIREKYNEEDINGFINRQLVETRQITKHVANILNNLYKDTNVIYLKADLSHNYREKYDLFKFRDINDYHHAHDAYLAAVLGEYKERFMKRKINFDMVKELNSKIVEMDEGKRRNLRFGYVINSLDENLNDIVLKISENLVDNETGEVLFDAHEFNKRVEDTLYRNDILISRKTEIRTGQFYKETIYKKGKGTIPIKFGMPTDIYGGYSNTNARKLMLIEYNESKMKIIGLPMALAVRNNDAEINDYIKTQINLKKNSTFKIKKCSIPFETEIIYNNQNVFIKGYSIGHKNCEISNAIQLKIAKDKMKHWKYALQYLLNDKKQYIDFAEKYVNEIYDFLINLDLFPLFNKELDKIKNKVNFEDLALDQQKKITKELFKMLHCNSVNANLSEFGLGDRMGRLSGYNITDGIIISKSVTGIRESRYEF

SEQ ID NO: 883 - protein, 1344 aa, Artificial Sequence
  Cas9
MSQNNNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKENYHSNYNLFIDKDFNDKTYYDKYPTIYHLRKHLCESKEKEDPRLIYLALHHIVKYRGNFLYEGQKFSMDVSNIEDKMIDVLRQFNEINLFEYVEDRKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHPSKTPVDEFYKYIKKLIEKIDDPDVKTILNKIELESFMLKQNSRTNGAVPYQMQLDELNKILENQSVYYSDLKDNEDKIRSILTFRIPYYFGPLNITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKYKDSTRTPETVLEVMERTNMNLMQVINDEKLGFKKTIDDANSTSVSGKFSYAEVQELAGSPAIKRGIWQALLIVDEIKKIMKHEPAHVYIEFARNEDEKERKDSFVNQMLKLYKDYDFEDETEKEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRNQKNKGKEMKKNNDGFILNSMRNIYADKDTGEIVWDPNYIDRIKKCFYYKDCFVTKKLEENNGTFFNVTVLPNDTNSDKDNTLATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAPTEIINAKQLILNESQTKLVCEIYKAMKYKNYDNLDSEKIIDLYRLLINKMELYYPEYRKQLVKKFEDRYEQLKVISIEEKCNIIKQILATLHCNSSIGKIMYSDFKISTTIGRLNGRTISLDDISFIAESPTGMYSKKYKL

SEQ ID NO: 884 - protein, 1344 aa, Artificial Sequence
  Cas9
MKKTNPYILSLDIGTASIGYACMDLDFNILKYHDKDAIGVLTFEGADTAAERRGFRTSRRRKNRRIKRLGLLQEVLAPLVKNPNYYQLLNLHKWKNSNEDFKHRSLSEVLKILGKNPKTYPTIYHLQQDIQNHPEKKFEPELIFLALYHLVKYRGHFLFNNLSFDKGKTVDNEAQLSELLEQYQSINPYEDSISNKDINVIVDTLKDDQLTRNDKSKELKRNVSKTHAELFKMLVGLKFKQSILFENMENAEDIKESATGSDAISLSDDYYENLSEFLTDEQLNFIESANTFFMGIMLDRILKGATSISAAKVRDYKIFKNQLKIIKDIVYQNKYDKYHEFFVTSKEDMRAYQENPDAKTFGKLSKFDQYLIHPKDQYAKLMKDLKGIVPKKYTEVLNLIDEQKFLVVQNTTDNASIPYQNNVFEAENILRNQQKYYPEITEEMIGKVINLISFRIPYYVGPLTNKNGQSDFAWMIRKSDEQTLPWNFDKVIDKSKSAEKFIRRMTSKCTYLLEEDVLPKHSLLYQEMEVLNELNNVQLRGENEPKHRIHRLDPKVKQFIYHNLFQKKKNVTHKDLITLLQNSEHRNTLNKTSGQKLKVFGTQNDSKFASKLSTYNDMKAIFGSVENKRQMIEELVLWITIFEDKAILKQKIGEKYPNITEKQLNQIVKLNYSGWGRLSEKLLTKEVNGRSLIDLMYSTENNFMEIITDKTLGFDCFIKNSNKVKNAKISYKDVAELRTSPALKKGIWNAIKMVREISDLFGAPEKIIIEFATEDQVKGKRQKSRSELWDDLVKKNNLKRNKKFKGLFEELKAYPDLDFSNPKLWLYIHQNGKCMYTKKPIDLERLMSDTNNQLYEIDHILPRTFVKDDSINNKVLVIQSANQKKSGDKMPLEIFDNHVLVPFWKMLYENDLISSSKLSKLMKKEFNDLDKEGFIQRQLVETRQIISHVSDFLTEEYPSTTVVPMKANVVSELRRKFDIPKIRQLNDWHHAVDAYLNGFVYQAARVFYPKVNLFEFNFKWEKVREKWRQLGEFTENNKKREFFLFKRMENYVNEHGEGMISKLIFDLDNFKFNYSRKVESTESAFYKQSAFSPKNTTAQYDSDKNKTAIYKEMKNKRGIVVSYTYVKKDQELIGYGVFNETVFEYVNNADVDMNTRALKIVRKAFPKLDIKKAQYLFSINKGDALLVNGHPFLFVSAKERINGKQLEFDINMQRRLKKALRPYNKMTEQEKVGVYNQFAEKVVQEYENSLGAKTRNEKLELIRNQFNESDKSNEALIQCILEVLKMTKVSAERSVKLKIRWGSQTPNTLIDINNKAKIMYNSITGLKQTRLKSIYKLAESKNEL

SEQ ID NO: 885 - protein, 1344 aa, Artificial Sequence
  Cas9
MNKNYYIGLDMGTNSVGWAVTDQEYNLIKLKGTHAWGARIFQEAKDKKGTRAIRSSRRRMDRRKYRIHLLNQLFAQEIQAIDSTFFIRLAYSAYWEVDKKDKGIGRNILFKTKQEESQFYKKYPTIWHLRKSLLENQPDAFSDLRYVYLAFHHIMKYRGNFLHEGEIKTNELQVQQIEQLNQFLINKYKEIYDNDVEERTFIANHQIDALKEILLNKNTNKTTKEKEIKKLFDYADCESLEPYISCFSKLAVGGKFDLSKLGYEGNIQFSDPSFEEKASILQDDFRLIAIAKEMYDFVILNDLLKDQPNLSTAMVHVYETHRQDLKKLKDIIIDIDANKGLQNNDRWYFKLFKDKNAPKNYSAFIHKNSNQKRPSIDEFNDEIKKILIEHRNDVSLEKQDDLKMLFEKVENKTLLKTIAIQSTSVIPHQLHLDELEKIIDNASTKYPFLSNIRDKLVLLFTFRVPYYYGPLNDKSPYSNVERKQFATVTPWNFDEIFDENKTREKFMKKLTNNCTYLSGETVMPKKALAYEDYLIYDRLNVLLVNGEYLSLQEKEKIYHYLISRPKTTLDQLKKELAKWHNQSPIDIIFSNIHEEIPFEASSHAHLMKSFDLEKQKEELERYITLATIYADDKKSLKELLKNESLLDENQKNVILTLPTKKWAPLSYKLLQNIVYTDDYGVVHSILDIMKETNQNFQMVLHNEQYHFKELIEQENQKFTQEKTIEDLIEEKLESIPSLTQRSIRQTLLIIDDIIKASHQKVPEKIFIEVTRNNDDKRKGQDGNQLARDKELNRFLTNLLKDEKANQFCDVSQLLKDLEEVDKVKLKGKHIYLYFKQLGIDLYTGKKIVLNQLLTSTKYDTDHIIPQSLIKDDSLDNLVLVEREVNLKVKGNHYPVPSRIQDEQKKLWHFLLQKKAISEKKYGNLTRTSKIKLEEVEDFVARQINVINYSNVIIRDILKLKYPHTDIIFSKSQYPSFIRKHLKIVKNRDVNDAHHAVDAYLNVVSGNLLSTTFSKAYIRKKYIQIQDGEKETFNMETILENYFKNNENQLKIKTNCLRRDALITFKVDYFSGEFYGQTRLPKGNENLIPITLNEDNPMSDTSKYGGYTNLAQAYLFAVSYQEDGEMKKAILRVPYLYDTLYKNDSDKLLSKVLDNPKATNIQILRKIHLNQKIRFNDGIYLLYTNEKDRNKYKMAYQNYIDNDYLYYLHWANKHLEELLDNQEKQTFIYNSKNDQFEVSKAKNKEIFQYLLQKTKAKVYDTCNYIVKARETNIEIFEQLTLKEQITMINQWIKMMSRDCEKVKFDARFTNFSNCLLRLSNNINPKDSITIIYESPTGLFKHEVKI

SEQ ID NO: 886 - protein, 1344 aa, Artificial Sequence
  Cas9
MKKTNPYILSLDIGTASIGYACMDLDFNILKYHDKDAIGVLTFEGADTAAERRGFRTSRRRKNRRIKRLGLLQEVLAPLVKNPNYYQLLNLHKWKNSNEDFKHRSLSEVLKTLGKNPKTYPTIYHLQQDIQNHPEKKFEPELIFLALYHLVKYRGHFLFNNLSFDKGKTVDNEAQLSELLEQYQSINPYEGSIFNKDIKVIVDTLKDDQLTRNDKSKELKRNVSKTHAELFKMLVGLKFKQSILFENMENVEDIKESATGSDAISLSDDYYENLSEFLTDEQLNFIESANTFFMGIMLDRILKGATSISAAKVRDYKIFKNQLKLIKDIVYQNKYDKYHEFFVTSKEDMRAYQENPDAKTFGKLSKFDQYLIHPKDQYAKLMKDLKGIVPKKYTEVLNLIDEQKFLVVQNTTDNASIPYQNNVFEAENILRNQQKYYPEITEEMIGKVINLISFRIPYYVGPLTNKNGQSDFAWMIRKSDEQALPWNFDKVIDKSKSAEKFIRRMTSKCTYLLEEDVLPKHSLLYQEMEVLNELNNVQLRGENEPKHRIHRLDPKVKQFIYHNLFQKKKNVTHKDLITLLQNSEHRNTLNKTSGQKLKVFGTQNDSKFASKLSTYNDMKAIFGSVENKRQMIEELVLWVTIFEDKAILKQKIGEKYPNITEKQLNQIVKLNYSGWGRLSEKLLTKEVNGRSLIDLMYSTENNFMEIITDKTLGFDCFIKNSNKVKNAKISYKDVAELRTSPALKKGIWNAIKMVREISNLFGAPEKIIIEFATEDQVKGKRQKSRSELWDDLVKKNNLKRNKEFKGLFEEIKAYPDLDFSNPKLWLYIHQNGKCMYTKKPIDLERLLSDTNNQLYEIDHILPRTFVKDDSINNKVLVIQSANQKKSGDKMPLEIFDNHVLVPFWKMLYENDLISSSKLSKLMKKEFNDLDKEGFIQRQLVETRQIISHVSDFLTEEYPSTTVVPMKANVVSELRRKFDIPKIRQLNDWHHAVDAYLNGFVYQAARVFYPKVNLFEFNFKWEKVREKWRQLGEFTENNKKREFFLFKRMENYVNEHGEGMISKLIFDLDNFKFNYSRKVESTESAFYKQSAFSPKNTTAQYDSDKNKTAIYKEMKNKRGIVVSYTYVKKDQELIGYGVFNETVFEYVNNADVDMNTRALKIVRKAFPKLDIKKVQYLFSINKGDTLLVNGHPFLFVSAYERINGKQLEFDIAMQRKIKQALSPYNNMTEQEKVEFYNQFAEKVIEEFRNSIGLQSRDRKVNLIKNLFNNTEKSNDSMTQSILEVLKMTKVSAERSKELKIRWNGQTPNTFIDTKNNAEIQYKSITGLKTTKPKSIFKLAESKNEL

SEQ ID NO: 887 - protein, 1345 aa, Artificial Sequence
  Cas9
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 888 - protein, 1345 aa, Artificial Sequence
  Cas9
MENYNIGLDIGTTSVGWAVVNDATNKVMRKGGKALWGVRLFDPAVTAEDRRAKRGTRRRYDRRRERIKLLQDEFKDEINKVDSNFFLKLEESKYTSKDIKNKTVLISMEEEKAIKKYNQEYPTIYHLRQKLMNSNEQMDIRLVYLAIHHIIKYRGNFIYEGNSFSVNNLNIDNKLKEIFLSLSEDVDELDISEECINNINYKQLANIFNEQSKNDLKVKLTSELTSYSLNKNFISEFCKLIIGNKFSAKKLFNLETDNDVSLSFDGTDFEDKAGDLESLLNDYLEVLEQLKELYDMVFLKKIFGGSKETTISGLMVERYNQHKKDLKLLKDTFSSDRKIYNKIFRSKKDIKDDKDMCLYDLYIHNKLETTDFLKEIKKYVNTDNFIITDEDFLKRLENNEVLPRITSKENGKYPYQLNKDELVSIIEHQGKHYPFLLNKTDDGIYKLVRLLEFRIPYFVGPLVSKDMSENAWMLRNEGMQGVHITPYNFKKVINLDKTAEIFIKRMISHCTYLLDEEALPNNSILYSEFKVLNELKQIKVNGEHLTKDEQHKIIEELFMKTSGTITENKFREFLLNTLDYNFYENELKITGYSADCKFANNMQSYIDFFGENGIFEGTSYNTNDAEKIIEWITIFDDKDILKRKVENEYPELKSNQVKNILNKKYSGWGRLSRKLLLDLRVLDKETDIPKSIMDLMYETDENFMQIINNDKYNFQKLIAKENKIENTSNDLSYDVVENLATSPATKRGIYQALKVVKEITTYMGYEPKNIMVEMARGDEKKIRKDDRKKYLQKLYDNIKDEVDSNYKNLKKELAKEEKIDTDKLYLYYLQEGKCLYCGKPINVDDLNTKNSLYEIDHILPRTLIKDNSWDNRVLVCRGCNQKKAASLVLPKEFRNDYTKSIWIRLKNNKLMSNKKFYNLTRKSYSEEDIKGFINRQLVETRQITKHVANILNCFYPKTKIVYLKANISHSYRDKYDLFKFRDINDYHHAHDAYLAATLGSYQEKYLHYDLDYNKINEFNEKLIKNEDYKRLHYGIVVNSLDEEFQSAFAEIAPRLINEETGELLFNAKKFNDLVEDTLYRNDILISRKTEIRTGKLYKETIYKRGKGNIKIKENMPTETYGGYSNMETSYLTLVKYGNKTKLIGIPMSIANNKDVKVKLDFIKEHLDLKSLDNIVILKDNIPYDVSINYKNQDVYVKGYSTANKNCELSNAHQLKIKKDMMKKCKYVLNKVYKNKYDDITNMDIENAITFINYLFEIKIEFPLFSKEITKIQDNINLTECSFEQLANIIKQLLIIYHCNSKNGNLKEFGLSDRIGRLSGANVTGGDFIFTSVTGLKEKTASYDGE

SEQ ID NO: 889 - protein, 1345 aa, Artificial Sequence
  Cas9
MVEKYGIGLDIGTSTLGWTSVDENGKIQRLKGQTALGTRLFNEGQTAEERRGFRTTRRRIQRRRWRLRLLREIFDEPIGSVDAGFFARQKMSSLSPQDDRFEDTYRLFNNQTDKAFHDEYPTTYHLRQALMNSDRQFDIREIYLAIHHIVKYRGNFLRSGKPADFKTGKLDLKEKFEEINADWQTLISEDAPQLPVDDLTTIKAVLVDGSRSRSDRQRGLVKLWMANETVEKNWKPVMTELAKAILGLKTKLYLLTGLDLPKEDQKAWTFSLDTLEDHQGDIDSFFDDHAQQLIDRLAELRAMIQLTEIIPSGLNFSQSMVQRYEAHRSHLEMYKQYALDQTDPKRTKALRAAYNAYIDQHEIADDFYTAVKRVTKDDQSETAEEINRLIGLEQFMPKQRTKENGVIPYQVHQQELDQIIAHQKKYYPFLGTENPVIDHRESQPYMLDELVSFRVPYYVGPMVAANPELKTTENPFAWMIRKAQGEITPWNFDEKVDRKGSATAFIERMKTTDTYLLGEDVLPQQSLLYQRFMVLNELNNIRIDDELLTTNQKQWVFDRVFKGKGTISAKHLQDALKHHGETDGLPKISGLADPTKFNSALTSYRDFQKWLPNDIDRKDRTADIETIINWSTVFEDTHIFVEKLKEIEWLTADQRRRIASNRYRGWGRLSKHLLTEIKDEQGLSIMDQLWRTQHNFMQIVHEPDYAKQIEAANTVGMAKQDIGTVINDLYTSPQNKKAIRQVLAVVKDIQNAHHGVAPSWIFMEAARGADQNPQRSRQRQRQLQDLYAKTAADLVDTEVQQELTDKIKDKANFTDRLMLYFLQNGQDMYSKEKLNIDRLSEYDIDHILPQALIKDDSLDNRVLVHQSINRNKSDTFASEKYGAKMQGAWHQWRAAGLISARKLRNLEMRPDEISKYATGFIRRQLVETRQVIKLVTEILSHQYNPEETKLVSVKAGLSHELRREAGLPKLRDLNDYHHAIDAYLAARIGTYLLKRYPRLERFFVYGQFQTSRLDLRRFNFIHDLVKSKQGVIVDSDTGEILWDRQKDIDYIKHLMGLKHLLVTHEVYDSAAEMYAQTIFKASDNDSKVLIPTKNDRPTAIYGGYTKRRNGYLAILKITEKKAETYRVVGVPTLYMSQLATARSHSVEAEKALLKSLMAPEILSESKVVSFEVVVSHVHLNQLVRDTVFGPAHYFGLGPFRYVRNFHQLVLPFKDQEILVKRTPTDEELNTVFEDICWQVENYFAVFDINGFRNALKKSIDKFEQLPIENVFKDKKLVTQGKKEVLAFVMQGLHANASYRNLKVSLGIKTPLGQLQLTKFMLSRDAELIDESPTGLFRRIRRLKDL

SEQ ID NO: 890 - protein, 1345 aa, Artificial Sequence
  Cas9
MGNKLRNVDDYYLGLDIGTESVGWAVTDKYYVIPKFKGNAMWGVHLFDEGETSVKRRGFRSARRRTQRKRERLALLEALFDEEICKKDCTFFRRLHESDLWPEDKSGDDKYAVFADENYTDKDFHKEYPTIYHLRYELIKNKEPHDVKLVFLALHHIIKNRGHFLFDSLSSAEDFNSAYETMCSYLSDNEIQLNCSDIEQFKAILKDRRQGKIEKTKNLASLFGITKKSDPVSYAVMAVLSGSTVKMCDLFGDDELKTVEKNNISFASGYEENEEIYASVLGDRFELVKILKAVYDWAVLADILDGKKYISEAKVAVYEKHKNDLKTLKKYVKTYLPEKYNEIFKISDGKKDNYVAYSGHIKESGKTGELKKTCNSENFCAYLKKTLGKNADLSYKEMFDEIENKTFMPKQVTKSNGVVPMQVNEEELKAILDNAKDYLSFLNSCDENGVSVYDKIIKIFEYRIPYYVGPLNTHTENSWLKRKDGVKIYPWNFDDVVDIDSSAEKFINNLTSKCTYLPECDVIPKCSLLYSKFTVLNEINNLKLNGEDIPVELKQGIYKDLFMTRRKVTVKQIKDYLKARGCYDNNDVLSGIDTTVKSSLKSYFDFKGFESLTFDDKESIIASSVIFGDDKKLLKKRLKKLFPEKLTDEDIKKICKLKYTGWSRLSKEFLCDVEFTYKKTGEVMNVITALWETNYNLMQILYSEDFCCDGDEKKNLNDKLDELSYTGDQHSLRKAVDALYVSPKVKRPILRALLIAKEIEKIQERPPKKIFVEVARGIDNREERHRDSRKNRLMELYKNCKKEAEKFCPYFDALSKKLSDEDESKLRRDKLYFYYIQLGKCMYTGEEISLGELMNGNGRFDIDHIYPRSKIKDDSLTNKVLVNKTVNNNKTNVYPIDAAIQSKMSPYWQMLRSSGLISEETYKRLTRKTPLTDDELSAFVSRQLTETQQSTKAVAHILEQLYPKPKTEIVYVKAALVHAFRQSNDMLKCREVNDLHHAKDAYLNIVVGNAYNVKVTHNKVNFIKGLQNNDKGYTVNPEKFFSHDIPGAWSVKDSMNTVRRFMNKNNIRYTRFPRKKQGGLFKINPLKKGNGQVPLKASGARSCIEKYGGYDKATSAYFSYVEYTDKKGKAVRQMFPVNLYEVKEYEADMQGFVTSRIAEASNVKILIPCVKYDACISFDGCRMFITKKTGNRIGYKPGMQLVLGYKYEKYIRNIENYLTKHKDREIIPRDNISAEENIELYDILTGKMLNTVLSVKFSGIGKKLEKRREKFVLCSPEEQCCVLNEILKILHANVLSGDLSLIGESPNTGTMKTNAKFSEIKDVHSIKLINQSVTGLFEQEIDLLK

SEQ ID NO: 891 - protein, 1345 aa, Artificial Sequence
  Cas9
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 892 - protein, 1345 aa, Artificial Sequence
  Cas9
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 893 - protein, 1345 aa, Artificial Sequence
  Cas9
MKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 894 - protein, 1346 aa, Artificial Sequence
  Cas9
MNQTKNYDIGLDIGVGSVGWTITDSQSQKVLKVKGKQGIGVHLFNEGQTAEERRQFRTNRRRLKRRKWRLRLLRELFDEPISSIDPEFFARLKYFNESSKDPKNKGYQPQLHDDLKDVDFYRQYPTIYHLRHALMTQKEKFDIRDIYLAIHHIVKYRGHFLMNGHSSSFSVAQTDWKADLTKLFELIQETRTNLDFSFDLTEIDTIKSLLFDKNLSRNDRQKEIVGLINNNSQLDKKDKALTKQLVESVVKGIVGMKTRTDILLGYEVDNKEQSKAWNFSIDELDDQMATIDPALSQNSQAHDIITLIQKLYMTVQLAQIVPEGQSVSEMMINRYNLYAEQLQQLKDYKKINLETGLLLREAYDELMTKALTAAPGKTIHDTFYNKVKKILKDQDNKQALSIKQAIEDSNYLIPLRIKSNGVIPYQLHQRELDAIIENQKEFYPFLATPNPVDGHQEALPYKLDELIGFKVPYYVGPMVDPEVDSDQNFAWMVRKEKGEITPWNFHNKVDITQSADNFIKRMKTTDTYLIGKDVLPQNSLLYQRYTVLNELNGIKVANKKLTIEQKQRLYDQLFKKKKTVKKQDILNNLVAAGEIHEDDNLTGLSNGTTFNNNLGSYIDYCKIIGQDKLEDASKQADIERIIEWSTTFEDANIFLTKLAEINWLTEDQRQKLSQIRYRGWGQFSKTLLTDIKDNKDNSIIDNLMSTKKVFMQIINDTTIKQKIDDYNQYHLNHADLKDTIANLFTSPQNKRAINQTLLVIEDIINAVGHKPNRIFIESAKDNRNAKNQLTQSRLKRIVKQFEDNKQHVDQSVYEELKQLDDGSHASIDDRLLLYFLQNGKDMYTGQPIDISQLSTSQYHIDHILPQAKVMDNALDNRVLVSSKANTEKSDRFLSEIPQFQQRSLWAELERMGFLTKAKKERLLMTSDEFKQNSVRFIARQLVETRQIIKLVNQLIIQEHPEVKLVNIKADLTNAFRKKFNFVKNRNANDYHHAFDAYLTSLIGSHLLKSHPKWEPLFVYSDYDKIKFDNAPQGVNIMKEFEQSKLADENGEIIWNKDEMMAYLERLYNSRQILITKKVYARHGNLFKQTIFKAGESDNLIPVKNNRSDIAIYGGYKSKQVSYYALISLHNKKRQKRLVAVYLIDIQKLQNLNESDYFKTLHTIIKERHNIKPEFDILADKIYQNQLIIDNKNGSNRPFRIEGDFKNDRQLYLPLQYQRWLASKEPTDEKLNRIFDHICEQLADYFPLFAGNACDKLLDNRDKFYQLSIKSEFNDKGKLIAEGKLSVIDKLLVAMHADSRNSNLAVIGLSSSWGRFKLHGGNEAIGTSVQLIHQSPTGLFKRIQRFN

SEQ ID NO: 895 - protein, 1346 aa, Artificial Sequence
  Cas9
MLSAGVMLGDVSALKSSRNSLFQKSKKLIENSSSDLTKVDYSKMREILLSIRNIAIRFFNNEDFKESDYYKEFPTIWHLRKNLMESDKKADIRLVYLALHNIVKYRGNFLQENNKDLRAANANAGAAAIDLSNALEEYFSLHEDESALTCVPNVADLQMTLEQPGLRNGERLDRIVAALNMPDRARAKLFAKACIGQKVEFSKLALGMEKQEGTNAYIWDDDKYDELVALCPEDFFPVLETLKNAYSAYVLSDLLAGKLSISASLIDSYEQHQNDLKIVKELVREYLGQKEYGRLFRGPKFANGDYNFNKVAKPSYTSYILGESLCNKQGTTREELVKELKRVFDDCSAIQADKRYQKIKQRLEDDPKFLIKQKTRANGAIPYQLHLEEMHQIIEKQGKYYPFLVEQQDLIEKLVSSRIPYYVGPLNGGHDPNHPYPTNPIDPKRKFAWSVRKPGMEHEKAYPWNVDEVIDSEETAERFIRRMTGTCTYLYGEPVVPRCSLLYEEFCVLNELNGARWGEGNGDTHRFDSSDRTEILEQLFKKRKRVTHKAIATWLEINHGVTNVKISGTQAENAFESKLSSYNDFCNLLGVDGLEDVCPLTKDDIEQIILWVTVFEDKKLLLQKLQRAFGDKLSEKQIASIMRKPYAGWGRLSSKLLTGIKRETPFGRISILDVMRDGDPRPGHHLDAMNFMEILREKDFGFQDRIDEINKERTKESGLLLSVEDLPGSPALRRSVNQAMHILKEIVSIAGKEPSRIVIEVTRDPDEEKRGHRTDTRYKQLSEALAAIKTDIVQFDSSLLAELKERKDSLDSERLMLYFQQCGKSLYSGKPLDINRLSEYQVDHIIPQCYIKDDSLDNKALVFASENQIKLDSLLLDKSIIRSQKGRWQELHRAGLISNKKFRNLTCTEISDRMMKGFINRQLVETSQIVKFVRQMCEQRYESSEVISLRASLSHNLRDRCGFIKCRELNDYHHAHDAYLACQIARFIGIRYPRWQDGISREFINKYIKQLVKKGKSSGKFFAGKSGFIIDSFMHDGFDRETGEIFRDGWDATFEITRMRRVLGYKDCFITRMPEEQTGAYWEETIYSPLDAKNGKNLQIPLKQSGKEGYLDPKKYGGTNTAFNAYFFAFVAKDARGRDKYFFEGVPVYLAKQLNEQPQILVDFANSIAATKKCSTAKILRSKVPLRQKFLLDGTSFYLGGRTGNKNVILSGVEFACGIDMAKMIDTAIKHPEELSQKELISIIQMLADTIERNSDRQASLINFRRFDDKLRNIDAIAASRIIKNLLNSMNGVKQSCDLSDLGGSKQSGFMQSNIATLFERITWCYSSITGMFEQRVSFEDLKNGI

SEQ ID NO: 896 - protein, 1346 aa, Artificial Sequence
  Cas9
MKKRNREEYYVGLDIGTSSVGWAVATPDYRIPKFRGHKMWGSRLFAEGKRAAERRQFRTNRRRLARRRDRLQILEELFAEEMAKVDNTFFMRLKESKFFLEDKTVKEKHILFSTDKFDADRFYKDNPTIYHVRKRLMEEEPQDIRELFLAVHHILKYRGHFLFAGSLEQNGDSIEELVRTLFGKQGLAILDDTIDSNEMVNILKNNEKTKSDRKKAVQELWNPLKDKVKKAQAAEMAGVVLGLNSDISKLFDNSDYKDLKINFSSGDYDEKRDDYANSIGDDIVLLDTMKALYDTLILSQILQGKQSISEAKVEDYNTHKEQLRALKAILKPHKRLYNEMFRENNKKDLSNYVAYISSYSEGKRVNREGFYKYVQAVLKQVDDSDSKQAILEAIRLETFLPLLRVKDNAVIPHQIHQAELEAILETARKKYKFLNDVSEGVSVKDKIIQLFTFRIPYYVGPLNPHSGETVADRKQGTGWVVRKQRGKVYPWNFADMVDVKASAEAFITNLTNKCTYLIGEDVLPKRSLLYSEFMLLNELNMIKYDGHELPVEIKRLYIEQVFKQEHKKQTKGRVLDFLKRNGLITGSATAVITGMDDSIKGDLQSYRDMVRIFGTGFDHSMAERIIRWVTLFGEAKDILENKIREVYGNSISDSQMRAIKKLKYADWGRLSQAFFIKIIGCDKSGVERNIITCLRESSQNLMEILSDQGTYIKQIKAWNHQHTTNMMDTLDYQLVDDLYVAPSVKRSIWQSLCIVEELVKIMGQAPKKIFVEVTRTNQAEKTKKDSRKKRLVELYTAIGKEGAAWKKEIEKHQAGDFRRKKLYLYYTQMGRCMYSHEPIAMDALFTSEYDIDHIYPQSLTKDDSWDNLVLVKSQLNKEKSDQYPLRPAIREKNKAYWQYLCRAGFISEKKYERLMRTTELTAEELSGFIARQLVETSQATKAVIGLLERIYKHTDICFVKAETVSQFRHQHNFIKIRELNNYHHAKDAYLNIVVGNVYHEKFTKNPREFIARSTERRPYNLNRMYDFDLLKQGRVIWQVPKSLETVQAMMKSNDVRITKKLLVQKGELYDATITKAHKTKEGMYFPLKGADARLRDVHRYGGYEKIKIAYYSVFSCCEKASDTIHTLIIPIPVYAAGLLQTEADLTAYAWQTKQKTKPIKDIYSMITPIYKKLCINTVVKIDGFKYFLGGRTEDYICLYPAIPVVLDEQAAAYLKAVSKVGRADDVENTAQAIDLITAEANEAFYDVLLKKMEAKIFVKAYQERVEKLASETARERFRKLSIGAQCSCLLEILNLLANNKTTSNLKKWLGVTMSRRKQPMDLTKLEECIVYETSITGLYEKAVSLL

SEQ ID NO: 897 - protein, 1346 aa, Artificial Sequence
  Cas9
MVEHYAIGFDIGTGSTGFAGVDPNGKLVRMRGKNVYGVYRFKGGEAAADRRGFRTTRRRIKRRKWRLRFLKSFFEPYIAPIDPEFFLRQKYSADSPLDPKGIRADKGLLSDMSDQEFHAKYPTIYHLRYQLMHEKRQFDVREIYLAMHHIIKYRGHFLIEDGADNFDAKQIDFFDQFQRMAAVTAGLPELETLVVPDETQSDAFKRVLFDESQTKSDRQKVLASQLLDIQDNQSKAIKDFIAALTKAVVGMKANLATLTSTAIESTDKNDWTKPLGQLDDFLLKHEEDLDEDGYALIDAANQMYSAAVLAALVPEGMGFSEAMMARYAQHKKQLALYKQVIASLPDKTQRHELKDAYADYIEHAAQNPRDAFYKRVTKVLEGVDSADARTVMTAISHDEFLLKQRTLSNGKIPYQMQQHEFDAIIENQKAYYPWLATPNPVEADAKRLPYYLDELIGFRVPYYVGPMVTEKQSQFAWMIRKADGELTPWNFFDVVDREKTANRFIQRMQTTDKYILGEDVLPKHSILYQQFEVLNELNNIRVEKHPLTTEQKQFIYQRLFVDQQRKTITKKNLQDTLVAMGEFDKAPDIGGLAKEDVMMSSLATFADYSKILPEAISDPTRQNDIEDIIAWSTIFEDTQIFFDKLKTVDWLTTQQRKRLASIRYTGWGKLSKRLLQQIPTSKHTNVMAALWATSDNFMQILQDEQFQEGLYDANRLPEETLTPDEQVEKILDEAYLSPADKKGARKVIKVMNDIVRANHGVLPEQVFLESADDPQKNKRRSVSRSKQLEEKYRQAAQSFIDEAVKEELNAQIVNSAEFNDRLVLYFTQNGRDMYTGKRLDIENLGSYQIDHILPQSLVKDDSLDNRALTARDINAEMSNQFVSERFGLGPRAFWQQLKNNGLISGRKFRNLVMQRDEIDKYAPGFINRQLVETRQIIKTVEQIIHRLWPDIQIVTIKANLTHQVRSELGFPKVRELNDYHHAFDALLAARIGQYLLEHYAGLKPFFTYGEFKRGDTKKYGTTNFLRRLTKDNKDKKGELLPEVSDWIDSIDSIYNYKKIPVVWENTTNMSALFDQTIYPRPDRDTTKRKLIPTKLDKPTDIYGGYSSAKTAYMAVMRVQTKKGTEYPVFNIPVSIASQLNRITDQTMLKQQVKQFIINAEQSASKKKLYESGDVILSRVALGQRFTDKNYGEVFLISNMEVQNPQSLWLGRASQQRLTREPEGNEKPETSLADIYQQILKQVDRYFLAFNIRQQRQKLLGTLDQFTSLPVGRVNEQTRTDQNQRSIIARVMIVLGKGSREEKFPEFGLSALGRLVRTGGITLSEDAQIIYQSPTGLFERRVALKDL

SEQ ID NO: 898 - protein, 1346 aa, Artificial Sequence
  Cas9
MAKILGLDLGTNSIGWAVVDIENNNEFTLIEKGVRIFQEGVKIEKGIEGSKAAERTTYRSARRIKYRRKLRKIQLLGVLSENGYCPFLSKDELDSWRYKKVYPTNKSFLNWQKTNEIQLENPYFYRALLVEKKLNLNIEEDRFKIGRAFYHLAQRRGFLSNRMEGTKENDGTVIKSITEISTAKGDKTLGQYFYERYKKGEKIRDTYTHREEHYLEEFVRICEFQQLDNKFAEKVRKAIFYQRPLKSQKGLIGKCVFEPKKSRCSVSRPEFEEYRMLCFLNNIKIKTPSDENLRFLTDNEKEKLKPQFFRKSKDHFDFEDLVKQLAPKNQFKFYKSRDILPGNWLFNYSMNTTVSGCPISARLKDLFGENFMDIKFDYIREKDGKKSVIDIHDIWHVLFTYDSEEKLKEFARNRLNLDDIKIKEFQRIQLKKEYAALSLKAIRKILPFLREGLIYSHAVFIANMETAIPSEIWNNYTNRNIIKNEIYNIISNQTEDKQVVDIVNGIIKSSRIENSVWSNEAVEFFKKDLNSKIKNYYGIKTYNDFPEEKKIRIETYAFNLFKQQMMKNFGRGEFAAVQRIDERLKLFLTDNFNIDPILLKKIYHPSAIEVYQPPVRKNDGKLYLGSPMVSSIRNPMAMRALHQLRKLINELIRKELIDSNTKVNIEMARELMNANERKAYQNWQNDREKIRKEYALKIKQHLDVDKEPSDVDILKYQLWEEQNHKCIYTGKEINISDFLGSNPKFDIEHTIPRSISFDNSQSNKTLCENYFNRSVKKNRIPAALPNHGEIIERLENWKLKYEELEKQIQYAVRQAKGAGDKDSKDRAIQKRHKLKFEYDYWKNKYDRFVMEDVPEGFKNSQLVDTGIITKYSRMYLNTLFDKVYTVKGNTVADFRKLWGIQDEYEKKARVNHSHHCVDAITIACITKSNYENLAKFYHDWEELHVKGIDQLPPMNKPWKTFTEDIKAIQYEILVSHYTPDNLPKQSKKILRKKGRIQKNENGNPIYLKGDTVRGSLHQQTFYGAIEKTEVNKKGEPEKVIKYVVRKSLDVLDDSSVKNIVDDIVKEIVQNARIKEKDFIKELEIQKRKLAKAEENKVVQIQAEIDKLNKQVADLYTMPNKNGNPIPIKKVRIFQTSVTNPIHLKQQRDKSQKTSKPHKEFYYAANDSNYMMAIYEGKDEKGKVKRDFKLLNNLEAGEFFKYSVHKDLKEKNLENIRNVIPDKVSAGKIEIPLKAIIKTGTMVILWENSPDEVWDLTISEVDKRLYKVVGMSVNRIKSDVKTFEFGNIVLRHNKEASPATLLKIQDGEFKSDENYIAQRKLSHNQFNALVEGVDFSLSVLGEIKRLK

SEQ ID NO: 899 - protein, 1347 aa, Artificial Sequence
  Cas9
MGEDGKPVRVKGKTAIGARLFQEGHVAADRRMFRTTRRRLNRRKWRLKLLDEIFDPYITPVDSTFFARLKQSNLSPKDSRKEFKGSMLFPDLTDKQYHEDYPTIYHLRRALMTEDKKFDIRMVYLAIHHIVKYRGNFLNSATVDTFKASKVDFKKSFNQLNELYSAINPEDAFQVDMNKSDETGRLFLDSSIRKFDKQKQISKLIPVVVEDKEAKKLNGKIALEITKAILGYKSKLNVVTQTEPEDPKKWAVKFDDEDIDSKLNDILPEMDENQQSIVEIIQDLYSQVTLNQIVPNGMSLSDSMIKKYNDHHEHLKLYKKLIDNISDTKKRSALKTAYDKYVGDDGKTIEQDEFYSNVKKNLDDSDLSKQIADLIEAEKFMPKQRTSQNGVIPHQLHQRELDEIIEHQSKYYPWFAEANPNKHDLHLAKYKIEELVAFRIPYYVGPMITPEDQEKSSQTIFAWMKRKEPGQITPWNFDEKVDRMESANRFIKRMTTKDTYLIGEDVLPDQSLLYEKFKVLNELNMVRVNDHPLKVSEKQAIYRDLFENQKRISVKNLQNYVKSKSGLPTGPKISGLSDPDHFNSSLGTYNDFKKMFGDKVDDPDLQDDFEKMIEWSTIFEDKKILRAKLDEVAWLSDTQKNEFKEIRYQGWGRLSKKLLTGIVDGNGQRIIDELWNTNKNFMQIQSDDSFAKRIHEANANQMKATDVEDVLADAYTSPQNKKAIRQVVKVVDDIQKAMGGVAPKFISIEFTRSEDRNPRRTISRQRQLENTLKDTAQALVKSINPDILSELDNASKSKKGLTDRLYLYFTQLGKDMYTGKPINIDEISNYDIDHIFPQAFIKDDSLNNRVLVSKAGNNGKSANVPLKLFGAKMGGYWKQLADAGLIGQRKLKNLQTNPDTISKFAMHGFIRRQLVETSQVIKLVANILGDKYRNDDTKIIEITARMNHQMRDEFGFIKNREINDYHHAFDAYLTAFLGHYLYHRYIKLRPYFVYGDFKKFREDKVTMRNFNFLHDLTDDKQERIADTETGEVIWDRKRSIQQLRDVYHYKFMLISQEVFSLNKEMFKQKLFPATLAKKSKLIQIKKDKPVDIYGGYSNNTDAYLTVVKLKGSKEDKYKIVGVPMRALDNLKHAEKESPQSYTAELRKALEPQFTKIKKNRKTGEVSKVVTNFDIVLGRLFYRQMVIDGSEKSLIASSVYQYNAKQLVLSDQAIRTISDQEGIDEFELSSQYDKVYDEIVQKVEKLLPIFQHRHFQERLNNGKSLFVNLPVHDVYEGNKLEQVGKKHIINSILGGIHANADRPDIDLFGIKNLGQFSSTSGINLSSDAIICYQSPTGLFERRVVLKDL

SEQ ID NO: 900 - protein, 1347 aa, Artificial Sequence
  Cas9
MTKREEPYNVGLDIGSSSVGWAVVDNNYHLLNIKKNNLWGARLFKEAETAQVTRGHRSMRRRYRRRRNRLNWLDELFADELAKIDPSFLLRMKNSWVSKKESTRKRDPYNLFIDEKYNDVDYFNQYPTIFHLRKELITEDKKVDIRLIYLAIHNIIKYRGNFTLENQNFDISQLSSNFSQQISDFFALFSDFGVIMPEDFDPDKISDILLNPNLSPSGKVSEAIATISPKTNVKAKIKIILLLLVGNNGDLKKLFDLETTEKIAVKLSSRHIDSELPIILSELNEQQENIITIANSIFGSIILKDFLGDETSISAAKVISFEDHKQDLQKLKTMWRETSNKEAVKAGKKAYEDYIGHEDSETFYKKIKKFLEKAQPVDLANKALAEIELENYLPKQRNRNNTVIPYQLNENELIAILDHQEKYYPFLKENRDKILSLLTFRIPYYVGPLQDSNNNRFSWMTRKASGAIRPWNFSEKVNVEQSSNDFIKRMRSTDTYLIGEPVLPKKSLIYQCYEVLSELNNTRVKDGSSNPKRLDVTIKQRIYNEIFKNQKSVSVKVLQNWLIKESYFKSPEISGLADKKKYLSSLSTYIDFKKIFGQRFVDDPVNSPQLEELAEWLTLFEDKKILLIKLQNSKYSYDQATINKLSTMRYQGTGKLSKKLLVDLKTTKKSIGKSGAESLSILDLMWSTKDNFMQIIHDADYTFEQQIKEFNYDTEDELTPLEKVANLHGSPALKRGLNQSIKVVADIVKFMGHDPEKIFIEFTRSDDFSKLTISRYRRIKKQYLEIAKAIKKIPAEFKDIKEYQTQLEENKGKLASERLMLYFLQCGHSLYSNKPIDLNMINSSKYHVDHILPQSYIKDDSLENKALVLASENENKIDNMLISHDIIATNLPRWQALKDQNLMGSKKFADLTRTTVTENQKKGFIQRQLVQTSQIVKNITLILNDLYKNTSCIETRATLSSEFRKAFSNFDETTYHYQFPEFVKNRDVNDFHHAQDAFLACVIGEYQLKKYPKDNLRLVYDQYSKFLDSLKKDTRKKNGRMPRYTQNGFIIGSMFNGKTYVDDNGEIIWDQKIKESIRKTFNYHQFNVVRQTIEQHGKLFNDTIQPHSDRYKLIPLKTNRDPAIYGGYNNDNNAYSVVLDVDGKKKINGIPIRIANQLKSDELDLSSWLENNIKHKKPMTILIDKVPKYQRIINEETGDLLITSANEVINNVQLFLPSMYTALISLLDSTKTEMYSKLLSNYEANILIDIYDYLLTKLKNNYPLYRKEWAKLAEHRDDFIESDLVTQASTLQQLIKFMHADPSNVNLKFGNFKGNRFGRKNGNIKLSKTDFIYESPTGLFKSIKHID

SEQ ID NO: 901 - protein, 1347 aa, Artificial Sequence
  Cas9
MKSEKKYYIGLDVGTNSVGWAVTDEFYNILRAKGKDLWGVRLFEKAKTAADTRTFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEAVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRIKGKPLDTDVKLKLIEELFKKKTKVTLKSIRDYMIRNNFADKEDFDNSEKNLEIVSNMKSYIDFNNILGDKFELEMVEDLIEKITIHTGNKTLLKKYIEETYPDLSSSQIQKIINLKYKDWGRLSRKLLDGIKGRNKTDDVNTVINFMRNSSDNLMQIIEGKNYSFNEYIDNLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDESELRSKKLYLYYTQMGRDMYTGEKIDLDKLFDSTHYDKDHIIPQSMKKDDSIINNLVLVNKNANQTTKGNIYPVPSSIRNNPDIYNYWKYLMEKEFISKEKYNRLIRNTPLTNEELGVFINRQLVETRQSTKAIKELFEKFYQKSKIIPVKASLASDLRKDMNTLKSREVNDLHHAHDAFLNIVAGDVWNREFTSNPINYVNENREGDKVKYSLSKYFTRPRKSKGKVIWTPEKGRKLIVDTLNKPSVLISNESHVKKGELFNATISGKKDYKKGKIYLPLKKDDRLKDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 902 - protein, 1348 aa, Artificial Sequence
  Cas9
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 903 - protein, 1348 aa, Artificial Sequence
  Cas9
MKSEKKYYIGLDVGTNSVGWAVTDEFYNILRAKGKDLWGVRLFEKAKTAADTRTFRSGRRRNDRKGVRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKQQLILLINDLLKIELEEEFMDSIFEILADVNEKKTEKKNILKELINAQDFNKQEGKILYSIFESIVTGKAKIKNIISDEDILEKIKEDNKEDFVLTGDSYEENLQYFEEVLQENITLFNTLKSAYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKYYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPIDTDVKLKLIEELFKKKTKVTLKSIRDYMIRNNFADKEDFDNSEKNLEIVSNMKSYIDFNNILGDKFELEMVEDLIEKITIHTGNKKLLKKYIEETYPDLSSSQIQKIINLKYKDWGRLSRKLLDGITGTNIETGEIDTVINFLRNSSDNLMQIIGSQNYSFNNDIDKLRKKYIPQEISYEVVENLYVSPSVKKMIWQVIRITEEITKVMGYDPDKIFIEMAKSEEGKKTTISRKNKLLALYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYKKSKIIPVKAILASDLRKDMNTLKSREVNDLHHAHDAFLNIVAGDVWNREFTSNPINYVKENREGDKVKYSLSKYFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 904 - protein, 1348 aa, Artificial Sequence
  Cas9
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 905 - protein, 1348 aa, Artificial Sequence
  Cas9
MEKNYYLGLDLGSNSVGWAATDEDYNFLRLKGKTAWGARIFSEAKDCKERRTYRSNKRRLARRKYRLVLLKQLFAEEMTKVDKTFFLRLANSTYWEEDKTKDSDGNEIGKNLIFKTHEEEKQYYTKYPTIWHLRKALIENDEEALSNLRYVYLAIHHIVKYRGNFLTEGEMGNDIPPITTIEEINQTLSLLEVDSSEDATDKTTYIKPESYNELFTILENNNLNKVKKQQEIDKLFISSKERSENIKNYINLFKTIIVGGSFSLKKINEDTEDISVDFTKDFENSEADISKALGDSFNLVLIAKKYYDYIILKELLGKNKEISEAMVQIYEEHKDDLKSLKTILKDLDNKLGNDGKDRIYYSVFKQEPTEKFKETNYLSFVQGGKLEELNKYIKKILENNEKDIDDKETYNALYEKACKGDLFKKQANACTSLIPHQFHLRELKKILENAGRKYSFLNDISDKIIKIFKFRVPYYYGPLNNESNAHSWVVKKEGQEKAKITPWNINEIIDTPKTRDNFFKKLTNSCTYLVGETVLPKTSLYYEKYLVLDRLNKMQVNGDYLSASEKNDVLKFILSRKTTTIEQIRTYLSKNKSTKANDISISNIKATDPFNAVSHAFYGKHPDLNINLCEELIKFATIYADDKKELKKFVSSNFNLTDEFIKEYLNTPTNKWGRLSRKFLCGGDQLEMYYVDDNGILHSILNILEETNENLQEILNNEKYGFNQKIADFNNTLTADKTTEEQIEDILDSTPALMRRSIIQTLAVVDDVIKAAGKAPQKIMMEVTRTDGKKEETKSRYVQLKKQITNDKVLTSDEKKELLTNLENKKIQLKGKHIYLYFMQMGIDFYTGKIMDINDVINGKYDIDHIIPQSMIKDDSLDNMVLVSKDYNQKVKKDIYPICDEIRNNMLDKWKGYYARKIISEEKYNRLKRTKELNADEINAFINRQINVVNYSNIQIKRIFEIKYPETKIIFSKASFPSLLRKEYEIAKMRDLNDAHHAVDAYLNIVCGNILTTLYTDIFYMFKEKKEDHKNISFNMEKRLINYIDKNNLKDKIKTSCLRHDALITYKPDYDSGKFYKETIFKKSGDKETGLIPLHTKGPMSDTKKYGGYSQLSQSYIIAVEYKLKNKTVKKLCRVPTLYLKQYKNDLNTIAKIMIDDEKATDIKVLRKIYLNQKIRYNGCYYLIYTSKEKQNKYKMAYQNYLDNDYLIYLNKCLKKIDELDDGELTSQEFIVNKDGDKFLIDKNHNLEIFKSIKEQYNKTIYDYTPYIVQSREMKEEDFNNLSLKKQIDTLLNMIKILSRSNEQAKFETAFFENFTKVFLKTMTITNEKVYIVNESPSGLFKGKEELI

SEQ ID NO: 906 - protein, 1348 aa, Artificial Sequence
  Cas9
MKKFEDYYLGLDLGTSSIGWAVTNEKYDILRFNKKFMWGTHLFDMGNTASERRIFRTSRRRLKRKKNRIELLQTLFSAEMSKKDFGFFQRLKESQYFIEDKTFKNKNTLFMDENYTDQDYHMEYPTIYHLRKALIDNEESAFEIRKLYLAISHILSHRGHFLFEGELSDNLDFDDIFNEFVKYLNEELNIDFKIKSDVSLQAIKEILTDKMLNRTKKKEKLSELLEEEKNKIYQEIWKLLVGNEAKMSTIFDDKEYEEAKIAFSKGNYDEKEEEYESILGEKILFVQKAKAIYDWMLLQNILKEDKYLSYSKVKLYNEHKKDLKILKDVLKNLDKKIYKEIFSENGLYEEYLRIEKKKIGSKEEKTKDILYNRLKKIFENRDNMAIEDILNKIELDSFLPKQKIKDNGVIPRQVHQKELEIILKNAEKYFKWLIEKDETGLSVSEKIMKIFKFKIPYYVGPLNSKSPFAWIERKEYGKILPWNFENMVDMSKTAEKFIKRMTNKCTYLPEKDVIPKNSLLYTKYMVLNELNNLKIRGEKIKVELKQKIYTELFQKNKKIGMKTLIEFLKSQNIVVTKVEITGIDGTFNTSLGSYIDMKKIFGEEKIVKDSYKKMIEDIILWITLYGEEKKLIKSKIEEKYPEKVTPEEMKLILKLKYRDWSRLSKEFLTEIETMDEETGELISIIEMLWRKNENIMELLSYKYDFSNRIKEYNGINEKEKNITYEDLVKDLQISPSVKKMIWRALVIVKEIKKVTNKSPKKVFIEMARDTQTEKKRTEKRKDKLLELYKNIKNDDSIKELEKNLKDKTNDDLKSKKLYLYYLQLGRCMYSGEVIRLEDLMNDNLYDIDHIYPQSKIKDDSFDNTVLVKKQINADKTNEYPIDKSIQNKCKAFWTSLKERGLMSNTKYERLTRTEGFSDDELAGFISRQIVETRQATKVLADLLKVIFGSDTRIVYVKAGLTSDFRQKFGIYKFRELNDYHHAHDGYLNIVTGNIYNTLFTDNPYNFIKDRKKDNRTYNLNKVFERENDVWNPDVMLSKIERYIYKIRPLFTRASYEQKGGFSDQNISSEKDKLRPLKSSGVLSNIKYGGYDKIKNSYFFIVEYTEKKKRVRSIETLPIYIKKSISTKEDLEKYCKEELKLQEPKVLVSKLNYKSLIYSNGHEYYINSKTADSITIQNGIQIILTKENYETYRKIYKNLEYLKLIYKDEKIREEKILEKIPKILKNNKNDRDLSEDEISEKFWKLYKEIFEKIKIGIFSKFKSTLPIYIEDCKKLKDFTTLNNYAKSRFIQEILKCLNSQQGEFDTKYTHNYSKKYNTKLSKSKILENDFYIINQSPTGLFEKKVFLDK

SEQ ID NO: 907 - protein, 1348 aa, Artificial Sequence
  Cas9
MGEDGKPLRVKGKTAIGARLFQEGNPAADRRMFRTTRRRLNRRKWRLKLLDEIFDPYITPVDSTFFARLKQSNLSPKDSRKEFKGSMLFPDLTDKQYHLDYPTIYHLRHALMTQDKQFDIRMVYLAIHHIVKYRGNFLNSTPVDSFKASKVNFDDQFKKLNELYTAINPEESFQINLANSEKIGQQFLDPSIRKFDKKKQIPKIVPVTMDDKAVDKLNGKIASEIINAILGYKSKLDVAVQCDPEDSNPWAVKFDDEDIDAKLQKILPEMDENQQSIIGIIQDLYSQVTLNQIVPNGMSLSESMIKKYNDHHDHLKLYKKLIGQISDSKKKTALKKAYDQYVGNDGKVIEQDDFYSSVKKNLDDSELSKQIMDLIDADKFMPKQRTSQNGVIPHQLHQRELDEIIEHQSKYYPWLAESNPNKHDLHLAKYKIEELVAFRIPYYVGPMITPEDQKKSGAAVFSWMKRKEPGQITPWNFDEKVDRMESANKFIKRMTTKDTYLIGEDVLPDESLLYEKFKVLNELNMVRVNGDSLKVADKQAIYQDLFENYKHISVKKLQNYIKGKTGLPNNPEISGLSDPDQFNNSLGTYNDFKKLFGDKVDDPDLQNDFEKIVEWSTVFEDKKILRAKLNEITWLTDKQKDDLESSRYQGWGRLSKKLLTGIVNDQGERIIDELWNTNKNFMQIQSDDDFAKRIHEANADQMKSTNMEDVLADAYTSPQNKKAIRQVVKVVDDIQKAMGGVAPKFISIEFTRSEDRNPRRTISRQRQLENTLKDTAKSLVKSMNPNILSELDNASRSKKGLTDRLYLYFTQLGKDMYTGEPINIDEISNYDIDHILPQAFIKDDSLSNRVLVSKAVNNGKSANVPLKLFGAKMGHFWKQLAEAGLINKHKLKNLQTNPDTISKFAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQARIADTETGEVIWDRETSIKQLRDVYHYKFMLISQEVYTLRGAMFNQTIYPASQAGRKKLIPMKADKPVDVYGGYSGSTDAYMAIVRIHDKKGDKYKVVGVPMRALNRLNTAKNVSDAKYDQELKEVLTPQFTKSKKNRKTGEITQTVEDFEVVLGKVMYRQLVIDGDKKFMLGSSTYQYNAKQLVLSDESIKTLASEGKLNEAQESAAYDKVYDEILDKVNKYFALYDTNKFRQKLSLGKDKFVGLPNHNVFDGSKKISSGKREILNEILNGLHANATLGTLSDIGFSTPFGKMQQPRGIGLSSNTSIEYESFTGLFKRTIFLKDL

SEQ ID NO: 908 - protein, 1348 aa, Artificial Sequence
  Cas9
MKKPYTIALDIGTNSVGWVVVTDDYRVPTKKMKVLGNTERKTIKKNLIGALLFDSGDTAEGTRLKRTARPRYTRRKNRLRFLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQLQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASASELQKGNELFLPVDYMTFLYLAAHYHELTGSSEDVLRKKYFVERHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 909 - protein, 1349 aa, Artificial Sequence
  Cas9
MKQKFYVGLDMGTASVGWAVTDDKYNIIKRHGKALWGVRLFKTANTAEERRIFRAARRRTQRRKQRMELLQEIFGDEISKTDIGFYQRMKESKYWFEDKRDINGKQPELPYALFVDDGFTDKDYHEQFPTIFHLRNVLVNEWTQKYDIRLVYLAIHHIIKHRGHFLFEGKKMSEVTDFGSAFEAFCKVASDNDIEITVDEEKLKDIEDLLKSRQKSKTAKKQELGKIIAGADKQKKALAALVTGCMVKLSEIFADKSLDDGERNKISFADSNYDEYIANVEETLAERFLLIAAGKALYDWAVLSDILEGSTYISEAKVKIYKKHGDDLRKLKGLLKTRPDEYKLIFGLPEKQANYSAYIGMVKKNGKKVPIDKKCTKADFYSFLKKTLNKINFEDEKEREIAESIINEIENETFLPKQVISDNGVIPYQLHEAELDRILKNAALYYPFLSEKDDEGYTNMDKIKAIFKFRIPYYVGPLNTYHSDKGGNSWAVRKQDGKIYPWNFESKIDAGESARKFIGRMTNKCTYLIGKDVLPKESLLYSKFMVLNELNNLRIDGEKVSVEIKQAVYENVFKKYQRVTGKKVKDFLIRSGIIGREQELSGFDQNFKSSLKAYHDIKQIAGDINLSQNQKEDIIKEITVFADSQKMLKKRLKIKYPELSDKQVTKLAAKKYTGWGRLSREFLEEVESVNKETGEVLNIISALWETNENLMQLLSNKYDYLSEIKRLNDEAEDKSEVVTYDDVQKLYVSPAVKRPVWQTLKIVEEISKIMGSKPERIFVEMAREPGQKGDVKVSRKSRLLEKYKYCKKEAPEIYENLVKEDDNKLRSDKLFLYYTQMGRCMYSNEVIDIEDLFTNRYDIDHIYPQSKVMDDSLDNRVLVKRELNSNKTDVFPVPKEYMDKAKTLWDMLKKKDLISKEKYHRLTRRDGFSENELSGFIARQLVETRQSTKAVTQLLTKAYPESEIVYAKANAVSEFRHKFGFTKVRSINDYHHAKDAYLNIVVGNTYYVKFTKDAAWFIRNNPGRTYNLKKMFEQGTVSRGGETAWVSGEDGTIFTVKRVMGKNNILFTRKAYEVRGGLFDQQIMKKGKGQIPVKNNSEDDRLCATEKYGAYNKASGAYFMLVESEDKKGNKIRTLEFVPVYLAKELEKSEDAAIRYCVEKLELKNPDVRVRKIKMDSLFNVDGFRMHLSGRTGKQLIFKCAEQLVLDEESQKILKKTAKVFADYKENKNIKISDKIELTDEMLIKLYELFYKKLKDTVYNIRLSTQVKTLESGKEKFEKLSLLDKCLVIEEILHLFQCQSVAANLSSIGGAATAGILVLNNEISRCGKVEIINQSITGFYEQVIDLKNI

SEQ ID NO: 910 - protein, 1349 aa, Artificial Sequence
  Cas9
MQKYYLGLDIGTNSVGWAVTDENYNLCKFGGKRMWGIRLFDGAQTAEERRMNRSNRRRLSRQKQRIDLLQELFAKEIAKVDPTFFIRLNESRLYMEDKSTGTKFPLFADPGYTDKEYYKEYPTIYHLRQELIKNPESHDIRLVYLACHHILKNRGHFLINGSFSDLKNLSFVCREMLDAFNELSKYQLMISDIDALEKILSDRKQQKSAKVKELVQIFECVPREDKSDAKICKEILSNLCKFLVGAKGNITRLFDTDFDEMETSSFSFGDSKYEDSLLPSLEENYPDYANVIQKIKAMYDWSVLVEIMAGENYLSFAKVNAYKKHKENLSILKSLMKKYCTPDVYQRFFYETDEKSSYGNYIGAIHNNGHSHTMKKCDEETFYKSLSKILDKLVVQKTDQDTLEILKKEAKNQTLLPLARTKANGVIPNQIHIQELRAILDNAKTYLSFLNEADEYGTIAEKIIRIAKFKIPYYAGPLSTRHKEQGANTWIVRKQEGRIYPWNFEEMVDLERSNNEFIRRMTNKCTYLIGEDVLPKNSLLYSKFMVLNELNNLKIRGHKISVELKQELYKELFCKKAKVTGKALLVYLKKKDAELTLEDISGFDADFKSSLSIYIDFKNHILREQIDDGKYQSIVENIIKWKTIFDVDSKMIEKLIAREYPNMFSSEQIKKICRLKCRGWGNFSSRFLNGIQGENTETKECFTIIEALWKTNYNLMQLLSKQFTFKDAIDCINADKVGKIDKVTYENTVKDLVVSPANKRAIWQTVQITEEIKKVMKCEPEKIFVEMARGGEKEKKRTISRKERLLKLYMDYKDENRDWIKEIESRDEQDFTNRKLYLYYTQIGRCMYSGEEISLEELMQKNSKWDKDHIYPQSKIKDDSLDNLVLARKDINNNKSNKLLPTGIQDKMKKYWKMLLKYGFISKKKYDRLMRTEDFSDEELSGFIARQIVETRQSSKAVAELLEHLNEHTEIVYVKAELVSDFRHDNNMLKSRRINDYHHAKDAFLNIVVGNVYNAKFTANPRNWIKKNRNTNYSIRRVFDYTVKRGSTIVWQGVKDGGHSIDGIKKTMARNDILYTERTYCEQGELFNATLIKKGNPNAIGLKKGLDPMKYGGYSSPKTSAFAFIEFDGKKGRQNHLVEIPVYIANIAARQPEYIKNHLEEKKGYQNVIVKKYPIQKNALIKLDGYPARLRGANEKSITLKNAVQLVLKPEYHETIRNVEKYLEYIDKDESVSKAARFSHTELDKLYDELCFKAENSIYKKRPANQSATLKNGQKTFLAITNLKEKAQVINNIITMFRCDATTTTNLKTIGGSANAGGMQVNKNTLTSQKVVLVHQSITGLFGTEEELL

SEQ ID NO: 911 - protein, 1350 aa, Artificial Sequence
  Cas9
MKKPYSIGLDIGTNSVGWAVVTDDYKVPAKKMTVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKTPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 912 - protein, 1350 aa, Artificial Sequence
  Cas9
MGKNYYLGLDMGTSSVGWAVTDEKYRILRAKGKDLWGVRLFSEAKTAAERRTHRTSRRRLDREKARIACLKEMFAEEINKIDPGFYQRLNDSKYFLEDKKEHQPYAIFADTGYTDKEYYDEYPTIFHLRKALLNIENDKKKYDVRLVYLAILNMFKHRGHFLNANLDDKSGGNLKEYIEMLHQSMVNILNINLKNVEIEKIEKILKSTQYSNSERLENLLELYELSKNKNKIETEIFKFICGLKGTISKIYVEDKFEDEFAKMTLSFRDSNFDEKIIEIEDNLDDDKYDMFLLIKQIHDWSVLANIMNGEEYLSVARVKLYDKHKKDLEVLKKYYKQNSMEEYNKMFRQMNDGNYSAYVGSVIYKDNSVRRGCKSKKEDFYKNILNTIKSWEDCEAKEYITSEIDKGNFLPKQITASNGVIPNQVHKKELKKILKNASEYLNFLNEKDESGYTISEKIVKLFEFQIPYYVGPIAYNIGNDESKHRHNMWSVRKEKGPIYPWNFEQKIDIKKSSEKFIRNLINHCTYLNDEEVLPKNSLLYEKFMVLNELNKLKINGEKISVELKQNIFNDLFKKGKKVTKKGLIKYLKEQGEIDNCEEVEISGIDGDFTNKLSNYKKFADIFGVQSLTYEQTDIAENIIRYSTIYGDSRKFLEERIREEYSNVLDEKQIKRILGMKFKDWGRLSKELLELSGVDKETGEIASVISRMWNDNYNLMELIATERFSYAYEIEQRSKKLEKTISTIEYEDLDELYMSTPVKRMVWQTILVLKELEEVLGCPPKRIFVEMARDVNAPKDRKDSRKKKLLELYKNCKKEEGDWSKELNAREESEFKSKKLYLYYMQKGRCMYSGKPIDLKNLLNDNLYDIDHIYPRHFVKDDSIENNLVLVEKNFNAHKSDNYPIENEIRQKMHSMWKMLRDGNFITEEKYSRLIRKEEFTDDEKAKFISRQIVETRQGTKVITDLFEQTFPESDIVYVKAGNVSEFRHKFKLIKCRNVNDFHHANDAYLNIVVGNVYYTKFTKSALNFIKDYKKNPEKNKYHMDHMFQYPVSRGGVDAWITKGAESISMVRKMMAKNTPMVTRMNYEKHSGQKGGISDQNICSAKIAKKNVYLPIKMGDEKLKNVEKYGGYGSLTAKYFFLVEHTIKKKRIRTIEAYPMYLDALNKENKLLNYCVQVLEYDEPKIIMEKIKVKSLFKINGYYYYLNAKSVNRIIWGNATQLFLENDINEYVRKISKNIECIDINSENNIKVYDIFIEKYSNKLFSNRLGNLKEAIIQNRNKFIELKINEQINVILELVRYSQDGVYSINLSQLGLSSTYAINRTSKEISKMKECKLINQSVTGLYENEIDLLTV

SEQ ID NO: 913 - protein, 1350 aa, Artificial Sequence
  Cas9
MQQYYLGVDMGSASVGWAVTDEKYQLVRKKGKDLWGVRTFDIAQTAEVRRVSRTNRRRQNRRKQRIQILQELLGEEVLKIDAGFFHRMKESRYVAEDKRTLDGKQVELPYALFVDQGFTDKDFYKQFPTINHLIVYLMTTSDTPDIRLVYLALHYYMKNRGNFLHSGDINDVKDIQSILEQLENVLKEYVDDWELSLKDKVDAIKEIYNKDLGRGERKKAFINTLGVKTKSAKAFCSLISGGSTNLAELFDDSGLKESEYAKIEFANANFEDSVEGIQALLEDRFAVIEAAKRLYDWKILTDILGDNASLAEARVKSYETHHEQLVELKSFIKKYLDRKIYQDIFINPNIANNYPAYVGHTKINGKKQELEVKRAKRNDFYAYIKKQVIDPIKKKVSDKAVLARLAEIESLIEVNKYLPLQVNSDNGVIPYQIKLNELRRIFNNLENRLPVLKENRDKIIKTFSYRIPYYVGPLNGVNRNGKSTNWMVRKEGEEGKIYPWNFEEKVDLEASAEKFIRRMTNKCTYLVNEDVLPKYSLLYSKYLVLSELNNLRLDGRPLEVSVKQEIYENVFKRNRKVTLKKIKNYLLKEGVISEKDELSGLADDVKSSLTAYHDFKEKLGHLTLTEDQMEKIILNVTLFGDDKKLLKKRLAALYPNIDEKSLSRMATFNYRDWGRLSKKFLSEITSVDQETGELRTIIQCMYETQNNLMQLLSEPYHFVEAIEKENPKVDLESISYRIVNDLYVSPAVKRQIWQTLLVIKDIKQVMKHDPKRIFIEMAREKQESKTTKSRKQVLSEVYKNAEKYKNLFEKLNSLTEEQLRSKKVYLYFTQLGKCMYTNDAIDFENLVSANSNYDIDHIYPQSKTIDDSFNNLVLVKKGINNDKSDRYPIDKNIRDDEKVKTLWNTLLSKGLITKEKFERLIRSTPFSDEELAGFIARQLVETRQSTKAVAEILSNWFPESEIVYSKAKHITNFRQDFEILKVRELNDCHHAHDAYLNIVVGNAYHTKFTNSPYRFIQNKANQEYNLRKLLQKAKKIESNGVIAWIGQSENNPGTIATVKKVISRNTVLISRMVKEVDGQLFDQQLMKKGKGQVPIKSSDDRLIDISKYGGYNKAKGAYFVFIKSVRRGKTIKSFEYIPVHLAKKFDCNLELLKEYLESEKDLNNVEILMPKVMINSLFNYNGSLIRIPGRYDKKSLLINVDVPLLLESQHIKQLKVIEKYMYKKRVSKNSNILLTKFASDQLKDLDALFDVLSYKLNENIYNVINDKYDKLVICRDKFISLDTEVKCEMIFELLHLFQCNSQLANITKIGATSKFGSISMSKNLKENDKMSIIHQSPSGIFEHEIELTAL

SEQ ID NO: 914 - protein, 1350 aa, Artificial Sequence
  Cas9
MKRILGLDLGTASIGWALVNESENEKEKSEIIKLGVRVNPLTTDEQTDFEKGRPLSVNADRTLKRGARRNLQRFKQRRKNLIEILIKKGFITNISLLTEIGSNTTYQTLELRAKSVKEKIEKEEFARVLLTINKKRGYKSSRKAKNDEEGSLIDGMSVAKELYDNNLTVGQYVYQLLEKGGKYIPDFYRSDLQNEFDVIWNFQKEFYPNILTGELYKKLQGQGQQNSRKLFLAIHQIYTAENKGKRDTVKKQHYKWRNDAINTQLLIEEVAYVLVEINNNLNKSSGYLGAISDRSKELYFNKETVGENLYKQIQENPQTSLKNQVFYRQDYLDEFEQIWETQAKFYSELTKELKEEVRDVVIFYQRKLKSQKHLISECEFEKHHKAIPKSSPLFQEFKIWQILNNIEFKHKKTKELKILSEELKETLFEELNIRGNFTSDAVLKFVKLDKKEWELNYKKGIEGNRTNEVLYNVYQKIAEYEGYGFDWSKKSAVEIKEELNTIFSEIGINSKILDFNPEISGNDFDKQESYQLWHLLYSAEEDGFLKQKLQDKYGFKSEYANMLANVSFQSDYGSLSARAIKKILPNLIAGHEFSEACSLSGYNHSNSLTKEELANRPLKGKLELLKKNSLRNPVVEKILNQMVNLVNQVIESYGEIDEVRIELARELKKSAQERALMTTNINASKTKYESFRKLLQKDFGIKNPTRNDIIKYRLYEELKANKYHTIYTNKYIPRDKLFSKEIDIEHIIPKAKLFDDSFSNKTLAFRKPNQDKGNMTAIDYILSYQSKDIDNYKSRIENLFKNGKGDISKAKRNKLLMEEKDIPDGFIDRDLRNSQYIAKKAKQLLEEVIRTVNTTTGSVTNKLRDDWGLINVMQELNMPKFKAIDESLIEQIEKKDGTFKTRIKDWSKRNDHRHHAMDALTVAFTRYNHIQYLNNLNAKSDKKGAIYGIQELETYVNSKGKRKFIKPMHNFREEAKKHIEDILISFKAKNKVVTKNINKIKSKDGFIKKVQLTPRGQLHKETVYGKINEVVVKEEKINAKFDLEKINKVTKPIYRNALLKRLQEFNGEPKKAFTGKNSLSKNPIYLDVAQTKTLPESVKVQFFEENYTIRKEISPDLKIDKIIDKGIQRILLKRLDEFNGKPKEAFSNLEKNPIWLNKEKGIAIKRVKIKGVKNVESLHNKRDHLGNEILQKGKSAPNDYVSTGNNHHVAIYQDKNGKLQEKVVSFYEAVARVNNKLPIIDQDFNKDLGWKFLFTMKQNEMFVFPSEDFKPLETDLMDKKNNSKISKNLFRVQKLGNKDYTFRHHLETKIEDIKKLRDFTYIRKRNPESIKNIIKVRINHLGNIVHVGEY

SEQ ID NO: 915 - protein, 1351 aa, Artificial Sequence
  Cas9
MSKKYYLGLDIGTNSVGWAVTDENYNLCKYAGKRMWGIRLFEGGETAEQRRISRSNRRRLSRKKQRIDLLQELFAEEIAKMDPTFFIRLNESRLHLEDKSTGEKFPLFRDKDYTDIQYYKEYPTMYHLRKELIENSKVHDIRLVYLACHHILKNRGHFLINGSFSDVKKLSSVCESMLNSFNGISKYQIEINDIERLEEILSDRKKQKSVKAKELIQIFECGPCEDKTDEKTCKAIVSNLCKWLTGLKGNINSIFDMQFEEIDTSSFSFTEPKYEDTISAALEEKYPDYADVIQKIKAVYDWSVLVEIMAGEDYLSFAKVNAYNKHKENLCILKEVIRKYCDSEIYHKFFNGFDEKNGYGNYIGSIYKNGHSYAMKKCSTEDFYKTLGKILDKIQPEKEDENVLEELKVEVKNQTLLPLARTTANGTIPNQVHIQELRAILDNAKKYLPFLNEEDEYGTVAEKIISIAKFRIPYYVGPLSTRHKEQGANSWIVRKQEGRIYPWNFEEMVDLEQSNKEFIQRMTNKCTYLIGEDVLPKNSLLYSRYMVLNELNNLRIRGNKISVKLKQELYKELFCTKAKVTGKGLFNYLKKEDEELALEDISGFDIDFKSSLTSYLDFKKQILGEEIEKDKYKGIVENIIKWKTIYDDDSKMMKKMIEREYPNVFSKDKIKKICRFKYSGWGNFSLSFLNGIRGADRETGESFTIIEALWKTNYNLMQLLSKQFTFREEIDLINAEKVGKINKVSYDNTVKDLIVSPANKRAIWQTVQITEEIKKVMKCEPERIFIEMARGGEKEKKRTVSRKARLLELYAACKDDVRDWTKEIEDREEREFNSKKLYLYYTQMGRCMYSGEEINIDELMQKNSKWDIDHIYPQSKIKDDSLDNMVLAKKVINNSKQNKLLSSDIRIKMKKYWNALYKGNFISKKKYDRLTRTEDFTNEELSGFIERQIVETRQSSKAVAELLNRLYEHSEIVYVKAGLVSDFRHDNKLLKSRRINDYHHAKDAFLNIVVGNVYNAKFTSNPRKWIKENRGTNYSIRRVFDYNVKRGNTVVWQGVEDGGHSIDEIRKTMARNDILYTEYTYCDKGELFNATLIKKGNDKAINLKKALDSVKYGGYNSPKTSAFAFIEFDGKKKERKNHIVEIPVYIVNIAKRQPDTIKEYLEQKKGYKNVVVKKYPIKKNALIKIDGYLARLRGANETDILLKNAVQLILNDKYYEIIRRVEKYLEYNVRYEAESMFEGFDHADLNSLYDELTSKLETSIYKKRPANQLNALEKGKEKFKNIQTLREKAQIIKEMLIMYRCDAATVANLKAIGGSANAGSMKIKKNTLTSRSLVLVNQSITGLFETEEELV

SEQ ID NO: 916 - protein, 1351 aa, Artificial Sequence
  Cas9
MYKKYGIGLDIGTSSIGWSVVDEYGHIIRVKGQTGLGVRLFREGQPAADRRTFRTTRRRLGRRRWRLRLLREIFDPYIAAQDPNFFARQKASAIAPGDSRFKAVYRLFNDQTDRQFYDKYPTVYHLRQKLMTEKRQFDIREIYLAVHHIVKYRGHFLTGGAAKNFKPGKLDLNTYFATINAQLAAIFMDSQVELPQLDWDAVVSLLTNDQESPSDRQKALTKMLVAQGDATQKRFYTEFSKALLGLKAKLYVLTGFEGDKTDQKALTLSLETLDDHQDDVTQLLGDEQRQLVELLARVQSAIQLAIIIPNGKTFSGQMVQQYQTHYDQLRLLKDYREQLTDQKHRRALKQAYADYLANDQDQDALVKAVEKVLKQNQPLSTVGVRLQTAIDAGDFLPKQRTKANSVIPHQIHQQELDRIIEAQSVYYPWLAEENPVAAHRSYAPYKLDELVDFRVPYYVGPLVQPQADKAAKETKFAWMTRKEAQSTTPITPWNFEQEVDRNASANAFIQRMKTTDTYLLGEDVLPKNSLLYQRFEVLNELNNVRVDGKLLTIAEKQRLFQDLFVDRSQASVTIAQLQANLIAHGAAKDRVEIKGLADPKRFLSSLTTYHDYAQIIPEALEQPDKRADIEKIINWSTIFEDTSIFKEKLQEIAWLTPDQRRQLSQKRYRGWGQLSDKLLTQLRDATGQSVMDLLWTEPNNFMQIIRRTEFQQAIARVNQTDLKQQDLATTINDLYTSPQNKKAIRQVLLVVADIQTAMHEVAPSWLFIEAARGPEQNPKRKLARQQQLLEAYKTSAKEIVNEAVKEKLLSAIDDHQKFEDQVVLYFQQNGLDMYTGKPLDFERLSKYHIDHIIPQSVVKDDSLDNRVLTTPEENERKGARVPGPLYASQQGRWRLLQRAGLISQRKLDHLLLRPEELDQQATGFVARQLVETRQVIKLITNILSQQYDPEQTKLVSVKAGLSHQFRTRLNLPKLRELNDYHHAHDAYLAARIGTYLLQRYPNLERFFVYGQYQKTRFDLKRHFNFIGEMLKGKPEDAVIVKAPHSETVIWDKQDEVKQLKKIMEYRHLLVTHEVYDNHGALFNQTIHPAKNPKNRKLIPRKTTQSTELYGGYSGETTGYLAIARTVTKNKISYQVLRVPTRLVGRLQRSSESAQRQILTDWFAPSFVSRGKQQPFEIVLRHVFKNQTVIDDIHEQSHRFGLRSDTYYCNQQQLVLSLEQQRMIIDQKLNNTNKLMVVYEAVCDQVAKYFPLYRMNHFKESLLEAGPKLAELPINTVQSKNGKLKLGQRSVLLQTMQGLHANPETKDLSIIGCPKYFGKLQVSSGIKLTENAVLIHESPTGLFQRRVRLSDL

SEQ ID NO: 917 - protein, 1351 aa, Artificial Sequence
  Cas9
MKILGLDLGTNSIGWAVVNEAENERESSSIIRLGVRVNPLTVDEQNNFEKGKPITTNADRTLKRSMRRNLQRYKLRRANLVSLLKTQGWITDETLLSEQGNNSTFETYRLRAEAATKEITLEQFARVLLMLNKKRGYKSSRKMKHDEDGSFVNNLDIARELYDSGLTPGQYAYNLLKDGKKYIPDFYRSDLQEELDKIWAYQYEYHENILTHSLRSAIIDQSKTGTTKIFLKTHGIFTADIKGNRNERNKQLFELRCGALERALTAEELATVIAEVNGQINSSSGYLGAISDRSKALFINHQTVGQYLMQQLDRDPNKSLKNQPFYRQDYLDEFEQLWETQAHYHPELTAALKHEIRDIIIFYQRRLKSQKWLVANCPFEHRKVCPKSSPLFQHFRIWQVLNNVTVTVDNKTYVLNEEQKSILSKELLYKEKISKRDALKMLFVKAKGVDMNFASLEGDRTMSNLLKAAQEIVSISGHGDYDFGKMPADDIHNIIRSVFGGLGFATDWLNLDTDADDLEQESQMRLWHLIYSFEGDNSTTGDTKLVERLMSLLNLPQEYARLFANVHLEDDYCGISSKALKRILPFMKAGHIYSEACALAGYKHSEQSLTREENKNRPLKDHLEQLPKNSLRNPVVEKILNQMVNVVNSIIDTYGRPDEIRIELARELKNNALGRQAIFEAINRNTKESERIQQILKKEFGLTHVSRNDIIRYRLYQELSGNGYKTLYSNIYIPQEKLFSKEIDIEHIIPQARLFDDSFSNKTLEYRDVNIKKSNTTAIDFVRNEYGENEVEQYKKRVNDLLKSGAISQAKAKKLKMTEAEIPNDFIERDLRNTQYISRKAQEMLRDVARVVTATTGSVTDRLRQDWQLVDVMQELNWDKYERQGLTTVINGRDGQQIRRITDWTKRNDHRHHAMDALTIAFTKPAYISYLNHLNARSEDDIRSIERRFLERDANGHLRFISPIAHNFRSEAKRHLEMILVSIKAKNKVVTRNNNTTKTKGGRRNRIQLTPRGQLHDATVYGSILLPHTKTIAVDGKMTAEIIGQVQNPVFRQALSQRLEACGNDPKKAFTGKNSLEKAPVWIDQAHTEHVPAEVTIQRLEPQHTIRRAVNKDLNINKVLDKGIQHILQARLDAYGGDAAKAFANLDNNPIWLNQEKGIAIKRVTTAENISGEPLHHKHDKEGRPILDTNGKPMPSDFVRLMNNHHVAIFQDADGNLQEHIVSFYEAVARVTELGLPVIDKEYNKDKGWQFLFTLKQNEYFVFPNPAQGFNPDEIDLTDERNYSRISPNLYRVQKMSSKYYVFRHHLETTVEDKKELQGITWKRIQSLNNLKGIVKVRIDHIGRIVQIGEY

SEQ ID NO: 918 - protein, 1351 aa, Artificial Sequence
  Cas9
MFSQQNNLYCESLSKLYYNITKNFLSKNEVCRIYEIFFCSILTYFLKKYNHDIFKKSSTMKTILGLDLGVTSIGWAVIVTDDDNTPIKILGMGSRIIPLSTADKEEFQKGQAISKNQSRTIARTQRKGYNRKQLRKEELKKILGELGITPSKELLNLPSIELWKLRADAASGNAPLSAEQLGRIFYMLNQKRGYKSARSEANQDKKDTDYVAAVKGRHQQLKEKGQTIGQHFYTEMLTLEENSGHFQVKNNVYPREAYLEEFNAIIAAQKPQHAFLTDDVVDRLRDEVIFYQRKLKSQKGLVSICEFEGFERTFFDNVKQKDKTIFTGPKVAPKSSPLFQLCKIWETVNNINLKVKNTDGSKNKWADYVPTLEQKQEIIEHLFKNAGISLDALRKILGFNKDEIFVNKQIEKGLQGNTTYAEIHKILGDSKPELLGFNINIEPSKHSALLVDKRTGEILAEKEGQQVSAEIEKENFYQLWHTIYSIKDLDECAAALIKRFNIDPNVAAQLAKIDFSKGAFGNKSNKAMRKILPYLMQGYNYADACSLAGYNHSDSQTKKEKEENVVDDKLKLLEKNSLRQPVVEKIINQMIHVVNAIIDKYGKPDEIRVELARDLKKSKDERNEAELQNASNKKLNEEVANRLKELGLPVTKRFVQKYKFIFPVRDRKIKEAQLVNQCIYCGETFNVTEALSGDNFDVDHIIPKSMLFDDSQTNKVLVHRKCNAKDKSNKTAYDFIAAKGENELAIYLDRVDDWFKRGVLSYGKMQRLKVSYEQYAERKQLKKETEADIKLWENFIERDLRQTQYIAKKSKDLLKKICNNVTVTEGKITAQLRNLWGWDDVLMNLQLPKYKALGQTEIKEWTSEHGRRLHKKEEITNWTKRDDHRHHAIDALVVACTKQGFIQRINTLNSSDTKDAMDREIKAAKEKYNELYDKKLLTETNEQVKNHTERFNKLETYLKSQQPPLFTTRYVEQEADKIFVSFKAGKKAATYGIRKIKKDGKKVVVQEKIVVPRGALHEQSVYGKIKTQEKDKPLKYLFENPETIVDNRIKILVKERLDKFEGDVKKALTSLKKEPLFIDNEKNTLLEKAACYTDATVLKYKLQALKANQVNDIVDEGVKRIVKARLAQHKNEKEAFKDTVWFNQEKRIPIVSVRVFARPDASKLAIIKTDENNKPIGFALTGNNHHIAIYKDNTGKLVQHICTFWSAVERKKFGVPTVVKNTGTLWSELLHKDLPGTFLDKLPQDGLELEYSLQQNEMFVLGLPKESFEDAIKNNDLPLLSKHLYLVWSISDNDYWFRHHLETKNSELKSTTGAKESKRYYRFQSVGTFTKENPIKVQLNHLGEITKIGEP

SEQ ID NO: 919 - protein, 1352 aa, Artificial Sequence
  Cas9
MKKRNREEYYVGLDIGTSSVGWAVATPDYRIPKFRGHKMWGSRLFAEGKRAAERRQFRTNRRRLARRRDRLQILEELFAEEMAKVDNTFFMRLKESKFFLEDKTVKEKHILFSTDKFDADRFYKDNPTIYHVRKRLMEEEPQDIRELFLAVHHILKYRGHFLFAGSLEQNGASIEELVRTLLGKQGLAILDDTIDSNEMVNILKNTGETKSDRKKDVQELWNPLKDKVKKAQAAEMAGLVLGLKSDISKLFANSDYKDLDSSIKNINFSSGDYEEKRDDYANSIGDDIVLLDTMKALYDTLILSQILQGKRSISAAKVEDYNTHKEQLRALKAILKPHKRLYNEMFRENNKKDLSNYVAYISSYSEGKRVNREGFYKYVQAVLKQVDDSDSKQAILEAIRLETFLPLLRVKDNAVIPHQIHQAELEAILETARKKYNFLNDVSDGVSVKDKIIQLFTFRIPYYVGPLNPHSGETVADRKQGTGWVVRKQRGKVYPWNFADMVDVKASAEAFITNLTNKCTYLIGEDVLPKRSLLYSEFMLLNELNMIKYDGHELPVAIKQLYIEQVFKQEHKKQTKGRVLDFLKRNGLITGSATAVITGMDDAIKGDLQSYRDMVRIFGAGFDHSMAERIIRWVTLFGEAKDILENKIREVYGNSISDSQMRAIKKLKYADWGRLSQAFLIAVKGCDKSGVERNIITCLRASSQNLMEILSDQGTYIKQIKAWNHQHTTNMMDTLDYQLVDDLYVAPSVKRSIWQSLCIVEELVKIMGQAPKKIFVEVTRTKQAEKTKKDSRKKRLVELYTAIGKEGAAWKKEIEAHQAGDFRRKKLYLYYTQMGRCMYSNEPIAMDALFTSAYDIDHIYPQSLTKDGSWDNLVLVKSQLNKEKSDQYPLRPAIREKNKAHWQYLCRAGFISEKKYERLMRTTELTAEELSGFIARQLVETSQATKAVTGLLERIYTNTEICFVKAETVSQFRHQHNFIKIRELNNYHHAKDAYLNIVVGNVYHEKFTKNPWEFIARSTERRPYNLNRMYDFDLLKQGRVIWQVPKSLETVQAMMKSNDVRITKKLLVQKGELYDATITKAHKAKEGTYFPLKGADARLRDVHRYGGYEKIKIAYYSVFSCREKASNTIHTLIIPIPVYKAGLLQTEADLTAYAWQTKQKTKPIKDIYSAITPIYKKLCINTVVKIDGFKYFLGGKTGDYMWLDPAIPVVLDEQAAAYLKAISKVGRADDVENTAQAIDLITAEANEAFYDVLLKKMEAKIFAKAYQTIVEKLASETARERFRELSIGAQCSCLLEILNLLANNKTTFTFFKDKMGVTMSRRKQPMDLTKLEECIVYETSITGLYEKAVSLL

SEQ ID NO: 920 - protein, 1352 aa, Artificial Sequence
  Cas9
MGKRYHIGLDIGTSSIGWAVMDDDFKIMRVKGKKGIGVRLFEEGKTAAERRGHRTTRRRYSRRKWRLNLLEEIFDPEIAKVDPTFFARLKESNLSPKDDRKQYSGNLIFPEKAKEEIREWTEKYPTIYHLRNALMTENRQFDIREVFLALHHIVKYRGNFLFNGNFQTGEVNLSDRFDDINSAFISACGEEEAPQIPSELYNDIQELLFDKNTRKLDNQKQLATKLSQDNDKDWSTQFSKALFGYKTKFKVVLQSNEDLDDFQLDSDDADDKIASISEQIDDDRGSILDNIKILYSRITLNEIVPDGKTLSQSMIEKYNLHRDHLKEIKDQLKHTDNWVKFDDLYSQYVNGKLESDRHKKLSSDDFYKKVLTLFDGELKTRVKEWQEKGEFLPKQRTGSNGVIPHQLHQNELDQIIENQSKYYPWLATLNPNEKRQRVAKYKLSELVAFRIPYYVGPMVTKDQSDFAWMVRKSDEKEITPWNFDQVVDRDKSAEEFINRMTTKDTYLIGEDVLPAKSLLYEKFTVLNELNNIRINGKPLTTDEKHQVYRDLFQNAKSISTKKFHNYLVCKLNKPNHLNITGFSDLTKFNSSLDSYIDLKKIFADQIDDQSLQDDFEKMIRWSTVFEDKQIFERKLSEINWLTDQERSEVAKLRYRGWGRLSKRLLAGIHDENGQRIIDALWNSPKNFMQIQAEVAFNKQINDLNTKELSDNNVEDVLADAYTSPQNKKAIRQVLLVVEDIQKAMHGDAPTSISLEFAREEQESSRTRSRRAALSATYRQISDEIVSATVKGELGKATSISDRLYLYFTQGGRDMYTGEPINIDEISRGYEIDHILPQSFIKDDSLDNRVLVKGAINNGKSANYVMDQSWAPDRLAWWKKLLDNRLISRKKYQSLTLTPGKINKYSQNGFINRQLVETRQVIKLVANILNDQYSNDDTKIIVVKAALNSQLRGFLELFKNRNINDYHHGMDAYLSTFIGNYLYKKYPKLRSYFVYGEFKKFSGKQNLKSFNFLHDLEDDSINIISNDDGEIVGNHHEMIEELEKAYQYKYMLVSREVFEKTGDLFNVTVYSRKAKKTLIPIKQDKPINIYGGYSGNNDAYMAIVKLPGKKGKPDTYKIVGIPLRFAGELERAKQLGESAYREKLSAVITPQFTKEKKDRKTGEITKVVDDFEVVLDRVPYRQLFKDSDKWFMLGSAAYQYNAKQLVLNNDDVKLLNEQGRKKLELPNEKLSSALNDVFDHIIQIMNSKFGLYDKNGFRTKLTEAASIFYDLPLRAEYNGNKKVTDGKLEVLDNILIGLHADPSFGNLKQLNMSTPFGQMQTKGGVVLNGNSTLIYQSPTGLFERRVKLKDLSK

SEQ ID NO: 921 - protein, 1352 aa, Artificial Sequence
  Cas9
MKKILGLDLGTTSIGWAFINEGENDNETSSIINAGVRIVPLTTDEEADFKKGNTISINADRTLKRGARRGLQRFKQRRDALLQSFRGINFISSNYVYAETGKQTTFSSYKLRAKSATELVTKEELVQVLLMLNKKRGYKSSRKAKTAEEGDAIDGMKIAKEIFENNLTPGQWVYNSLSIGGKFIPDFYRSDLQKEVEKIVRFQNQFHPEQMNEKLLENIQGKARTVTSQYFSRILNIPLAENKGTREETKLQHYKWRNEALTEELDLKVLAFIITEINNQINQSNGYLGAISDRSKELYFNQETVGQFQYNQLKENAHTKLKNQVFYRQDYLDEFEKIWETQSKFYPELNDELKSEVRDITIFYQRKLKSQKHLVSFCEFEKGHKAIPKSSPLFQEFRIWQNINNIVVKNETTKEPFLLGEDLKKVIAQELSFKESMTDSQLLTFCDLKKGTHTVNFKKIEGNRTNTSLFKAFEKILVLEGYDELDLSKLDASDIKSIIKSAFSDLEISTAILDFDPTIQGNDYDKQSYYQLWHLLYSSEEDDFLKKSLMDKFGFKESHLPFLLNINLQADYGSLSAKAIKKVLPHLMDGHIYDKACTLVGYNHSSSLTTDQNNERVLKDTLELLKKNSLRNPVVEKILNQMINVINAIIKDPAMGKPDEIRVELARELKNNNEQRSEMTKAINKSTTEHEQIRKLLHTEFGIHRVTRNDIIRYKLWKECDGISLYTGKPIEPSKLFTKDYDIEHIIPKSRLFDDSFSNKTICERQLNIDKSNKTAYSFFQEKLSAEEFDQFEKRVKSLFGKISRTKQNKLLMANNEIPEGFIDRQLRETQYIAKKAKEILLEVSRNVTATIGSVTDKLRDDWELVDVMKELNWEKYDKLGLTYIEEGKNGERLYKIKDWTKRNDHRHHAMDAITVAFTKPAYIQYLNNLNARTNTDKKGNSIIGIENKYLKRDKNNKLRFIEPIPNFREVAKKQLESILISYKAKNKVVTKNKNVTKKSNGTNQKIQLTPRGQLHKETVYGKLQQYVTKEEKINANFTPEYVTKVAKKEYREALLKRLIENENDPKKAFTGKNALSKNPIYISLENNILVPEKVKIVWLKSDYTIRKDITPDLKIDKVIDIGLKTILQNRLNEFNGDTKKAFVNLDENPIWQNKEKGIAIKRVTISGVSNAQALHTKKDHLGNEILDENGQPLPVDFVSTGNNHHVAIYRDEKGNLQEEVVSFFEAVTRNNLGLSIINKNHEKGWEFLFSMKQNEFFIFPTDGFNPHEIDLLNTENYHLISRNMFRVQKIATKNYMFNHHLETKSVDGEMLKTKKQLSKISYHFIQTPSYLNYIIKIRINHLGQIVQLGEY

SEQ ID NO: 922 - protein, 1352 aa, Artificial Sequence
  Cas9
MKQDYYIGLDMGTESVGWAVTDVDYNLIKKRGQDYWGVYLFDEAQTAQGRRAFRTNRRRLARVRHRLNLLQELFDSEISAKDFGFFYRLENSKYFDEDKPEIARGKFLLFNDKDFGDKEYYKNYPTIFHLRNALRTQEIKDVRLLYLAVHHILKNRGHFLFGEQDFNVNDASDVSGEFEKINRFLSENDGAGFDREKIPEIFETLCNENLAKRERKEKILELAGNSKNKLLGEAVNAVVGLNFSLSKMFGEDRDFQGENKMSFTDSSFEEKLAKARMALDDDEADFLETLKKVQSVASLHNILHGKEFISEAKTEAYETHRRDLSELKKYVRENCPEKYALVFRRQVKKGKKNTSGADENEKDDKKVNNYAAYIGMDKGKGFEKCKKEDFYAFLKKEIGINDESLLAKIDEGIFLPKQISAENCDIPYQVHLAELKAILANAENYFPFLKQKDENCEMTVSEKIISLMKFRVPYYVGPFTDKETRFSWMIKKEGLSTQKITPWNFDDVVDRDASEKKFIERMTNFCTYLTGEKVLPASSFLYSEYAFLNELNNLKVNGTKDLRVKNILFDFAKTNKKLTLKKCCEQLVKNGLLPEGSKARDVFSGTDGDFKNSLSSYIDFKRIIGDKADLYRDMCEKIILWITVISDKERLVKIIKDKYGTVLSDEEIKGLKALNYTKWGRLSEKLLDGIFETDSEGEVGNVSIIEKMRTDTENFMELLSNKHNYKRAIELANSESIVDERVTYRAVEELYCSPAVKRSIWSALKIVREIVKVQGHSPKKIFVETTREKPDVTRKGQRTVSRKQQLLDKYRENLRNETELIKKIEETEDSKFNSDKLFFYFTQMGKDAYTGEKIEFDDVFKTEKYDIDHIYPRSKIKDDSLDNRVLVRRKINQSVKKDSYPLSAEIRNRMEGLWRQLRDKKLISDEKFYRLTRSTPLTEKECGDFINAQLIATSQSAKAAIQLLKRMLPESEIVYSKAGNVNEFKKRLEFVKIRELNDLHHAKDAYFNIVVGNVFNTKFNHNPAVFQRSNGTGNYDFERLYDFDITNAWKKGDENRIRSVAEKNTCRVVRFSKTEKGQFYDATIYPAGKNDKLAPVKGKAPLNDTSKYGGYDKETTAYFMLVKSRDKKKKDKTLLSLECVTVLADKNFRTAEDKLKYCEKELGLKEPEILIEKIKLNTLFKINGSYAWIRGRTNDRLVLCNANQLWLDNGSAKELKKISNHFRDVKKYNNKDLPVREEEFSKEQNLALYDLFTEKLGGKIYAGLPVQGQIKNLEKGRDKFEALELKDQLFVLMEILKFMQCNSMTSNIKLIGGAENAGKNRISKLIQDSDVKMIFCSPTGYFCKVVDFKRFL

SEQ ID NO: 923 - protein, 1352 aa, Artificial Sequence
  Cas9
MKKILGLDLGTTSIGWAFIKEPEKDVVGSEIVDMGVRIVPLSSDEENDFAKGNTISINADRTLKRGARRNLQRFKQRRNALLEIFKEKKLISTNFKYAEDGPSSTFSTLNLRAKAAKEKIELQDLVKVLLQINKKRGYKSSRKAKSEEDDGSAIDSMGIAKELYENDLTPGQWVYEALQKGRKNVPDFYRSDLQEEFKKIVNYQSEFFPDIFNASFVEDWMGKASTPTKQYFNKKGVQLAENKGKREERRLQEYKWRAEAVNFKIDLSEIALILSQINSQISNSSGYLGAISDRSKELYFKNLTVGQYLYQQIKKNPHTRLKGQVFYRQDYLDEFERIWSVQSSFYPQLNDALKREVRDITIFFQRRLKSQKHLISNCEFEDHHKVVPKSHPVFQEFRIWQNLNNLLLIKKDNLNEKFDLELESKIALANELAFKRELNVKDALKILGLKPNEWEFNFTKIEGNRTNQAFFDAFAKIIELEDGEPIDLGDLKADDILDQFSEAFLRIGIDTELLQVNSDIEGAEYEKQSYIQFWHLLYSSEDDQKLKLNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPELGRPDEIRVEMARELKANAEQRKNMTSNIASATRDHDKYREILKSEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEISRRVSVTTGTITDKLREDWGLVEIMKELNWEKYDKLGLTYTIEGKHGERLNKIKDWSKRNDHRHHAMDALTVALTKPAYIQYLNNLNAKGLNNKKGTEVFAIEQKYLKRENGKLCFIPPIENIRSEAKKHLSRILVSYKAKNKVVTINKNKTKSKAGLNEQIALTPRGQLHKETVYGKSFHYSTKFEKIGASFNVQKINTVAKKEEREALLKRLAENGNDPKKAFTGKNTLNKMPIYLDLGKNIKLSEKVKTVVLEQNYTIRKNIDPDLKVDKVIDVGIKRILESRLEEFGGNAKLAFSNLEENPIWLNKEKGISIKRVKISGVSNVESLHVKKDHFGEPILDQEGNEIPVDFVSTGNNHHVAIYEDENGNLQEEVVSFFEAVVRQNQGLPIIKKNHTLGWKFLFTLKQNEYFVFPSDDFVPADVDLMDEQNYHLISPNLFRVQKIARKNYVFNNHLETKAVDNDLLKSKKELSKITYHFYQTPEHLRGIIKIRINHLGKIIQIGEY

SEQ ID NO: 924 - protein, 1352 aa, Artificial Sequence
  Cas9
MNKKYYLGLDIGTNSVGWAVTDENYNLYKYAGKRMWGIRLFEAADTAAERRMKRSNRRRLSRKKQRIDLLQELFSEEIVKKDLTFFIRLNESRLHFEDKSTGEKYPLFVDKEYTDIDYHKQYPTMYHLRKELIENPEPHDIRLVYLACHHILKNRGHFLINGSISDVKNLSFVCGEMIKEFNSVSEYEISLTDIRELERILSDKKTAKSVKAKQVAQLFECTPAEDKEQQKCAKAIITNLSKLIVGLKGNISKMFHQPLEEISTKSFKFTEAKYEDEIMPAIEENYPDYASVIDRIKGVYDWSVLVEILDGEDYLSFAKVKAYEKHGKNLHILKNVMKKYCKDEVYQAFFNGINEKNGYGNYIGAIRKNGHTYKMDRCKSEEDFYKGLQKILSTIVPDQEDEELLEKLKAEVENQTLLPLARSKENGTIPNQVHLQELMKILDNAKEYLDFLKKEDEYGTIAEKIISIAKFRIPYYVGPLSRRHKEEGSNSWMIRKEEGRIYPWNFGDKVDVEQSNKEFIERMTNKCTYLIGEDVLPKNSLLYSKYMVLNELNNLKIRGNKISVELKQRIYKDLFCTMAKVTGKRILEYLKMEDPEIVQEDISGFDIDFKSALASYLDFKKQVVGNEIEKDHYKEIIEEIIKWKTIYDDDSKMMRRMIEREYPEVFDKEQIKKICQLKYSGWGNFSDRFLNGVRGADKETEESYTIIEALWKTNYNLMQLLSKQFSFKEEIDQINAEKAGDVGKINYENTVKDLIVSPSNKRAIWQTIQIAEEIKKVMKCEPERIFIEMARGGEKEKKRTVSRKTRLQELYAGCKDDTRNWMKEIGDREEREFNSRKLYLYYTQMGKCMYTGDEIDVDALMKGNSNWDIDHIYPQSRIKDDSLDNMVLVRKDVNNKKRNKILSPKIREDMKGYWTMLCQKGLISKRKYDRLTRTTDFTDEELSGFIERQLVETRQSSKAVAELLNRLYKDSEVVYVKAGLVSDFRHDNDLLKSRRVNDYHHAKDAFLNIVVGNVYHVRFTSNPRKWIKDNRDSNYSIRRVFNYDVKQGDKIVWHGSENGGHSIDQIKKIMSRNDILYTEYTYCEKGQLFNETLAKKGNEKAIALKKNLDPVKYGGYTTPKTSAFAFVEFDGKKKERKNHIVEIPVYVVNIAKREPDAVKKYLEERKGYSNVVIKKYPIKKNSLIKMDGYLARLRGANEKDIILKNAVQLILNKDLYEIVRKIEKYLEYNLQYQADAKFEGFTMKDLNMIYEELYLKLKESIFQKRPAQQMKTLEKGKEAFISIENLGEKAKVINEIIAMFRCDATTVANLKVINGSQNAGSMKVNKNTLTSKSLKLVHQSITGLFETEEELV

SEQ ID NO: 925 - protein, 1353 aa, Artificial Sequence
  Cas9
MKKKYYLGLDIGTNSVGWAVTDENYNLCKFNGKKMWGIRLFEDAKTAAERRTKRSNRRRIARTKQRIDLLQELCEKSIFEKDPTFFIRLNESSLHLEDKSTGEKYPLFVDKEYTDIDYHREYPTVYHLRKELIENPEPHDPRLVYLACCHIIKSRGHFLVNGSISDAKDLSFICENMINSFNAASDYKINIQDMTALETILTDRKMAKSVKAKQIVQLFKCIPCEDKEQQKCCKAIITNLSKLIVGLKGDISKIFNESFEEIKSFKFAETKYEDEILPTMEEIYPDHAEIIEKIKSIYDWSILDEILDGEEYLSFAKVKAYEKHKKNLHDLKILIKKYCDDETYQSFFNGMNEKNKYSNYIGSIRKNGHTYKVEKCKSSEDFYKELLKLLSSVNPGQEDESLLEQIKFETENQTLLPLLRTKENGTIPNQVHMQELIKILDNASKYLDFLNEKDEYGTTADKIISIAKFKIPYYVGPLSDRHKENGSNSWMVRKENGRIYPWNFDDKVDAEKSNKEFIQRMTNKCTYLIGEDVLPKNSLLYSRYMVLNELNNLKIRGNKISVELKQQIYNDLFCTKARVTGKNILNYLKKEDPELAAEDLSGFDVDFKSALTSYLDFKKQVVGNEIEKDYYKEIIEEIIKWKTIYNEDSKMMKRMIGREYPETLNQDQIKKICHLKYNGWGNFSETFLNGIKGANKETGECYTIIEALWKTNYNLMQLLSKQFSFKEEIDQINAEKTGAIGKITYENLVKDLVVSPANKRAIWQTIQITEEIKKVMKCEPERIFIEMARGGEKEKKRTVSRKTRLQELYTGCKDDTRDWMKEIGDREEREFSSRKLYLYYTQMGKCMYTGEEIDVDLLMTANSKWDIDHIYPQSRIKDDSFDNMVLVRKDINNNVKGNNIVPSSIQKEMTSYWKMLLQKELISKKKYERLTRSTDFTDEELSGFIERQLVETRQSSKAVAALLNRLYKNSEIVYVKAGLVSDFRHDNKLLKSRRINDYHHAKDAFLNIVVGNCYRTKFTANPRQWIKKNRDTNYSIRRVFDFDIKQGDKIVWYGNKNENGKHTIDQIKKAMSRNDILYTEYTYCEKGKLFDETLTKKGNKKAIPLKKNLDPLKYGGYTSVKTSAFAFIEFDDKKKERKNHIVEIPIYVANIAKREPEAVIKYLEEQKGYVNIVVKKYPIKKNSLLKIDGYLARLRGGDSSIITLKNAVQLVLDKKSYEIIRKVEKYLDHNSKYEANSKLEKFNENDLNIIYNELCLKLRNSIYQKRPVHQLETLEQGIDNFRSLESLKDKAKIINELLAMFRCDAKTGMDLRLIGGASNSGRMRISKSRLTSKSLKLINQSVTGLFETEEELV

SEQ ID NO: 926 - protein, 1353 aa, Artificial Sequence
  Cas9
MEKNYYLGLDMGTSSVGWAVTDENYNLMRKKGKDLWGVRLFKEAKTSAERRVKRTSRRRLQREKARIGYLKELFADEINKVDAGFYQRMEDSKFISDDKTVHQKFTLFSDTNYTDEDYYNDYPTIFHLRKKLIESDDEYDVRMVFLALLNMYKHRGHFLNANLSDNGMGDINEQYDRLKELCSEYLNVEWENKPDKFEEILKECNCSNSLRNERLLETFNLKKTDKEKCEMLKLICGLSGTLSKIFKDLDDDSETKKMTISFRSSNYDEEAINVEEIIGSENFEIIAVLKEIHDWSMLANIMRGKKYLSVARVEEYEKHKDDLKILKKVIKEYSIEEYNNFFRVMADNNYSAYVNSVNSNKESTRRGAKCDNDTFFKEIKKIVNKCYDSEEKEYILKEIEKGTFLPKQIISSNGVIPNQVHKIEMKKILQNAEKYLPFLTEKDDSGLSVSERILQMFSFQIPYYIGPISGKIGSDEKSKNSWSVRKEKGRIYPWNFKDKIDEKESAEKFIERMVNHCTYLNNEMVLPKNSLLYEKFMVLNELNNLKINNENISVELKQSLYNNLFKTGKKVTAKGIKSYLERNGLCEPNEDINLTGIDGDFTNRLSNYAKFKGIFNTDELTYEQWNMAEKIIKWSTIYGDSKKFLEEKIRNEYSEKLDSQQIKRILGIKFRDWGRLSEELLNMEGADVNTGEIKSVIGRMWDENYNLMELIATDNFTYKQVIKEKQNGLDKSLSEIDYDDLDELYVSAPVKRMIWQTLLIIKELVSVIGYEPTRVFVEMAKDVNTEKKRTDSRKKKFLDLYKQCEKDERDFWIKEIDDKSEAEFRKKKLYLYYTQKGRCMYTGEQINPLDLTNDNLYDIDHIYPRHFVKDDSIENNLVLVKKEKNAHKSDTFPIEDDIRKNQYAFWKMLYEKNFITKVKYQRLTRKEPFSDEEKANFIMRQIVETRQGTKVITDILEKSFDKTQIVYVKAGNVSLFRQKYECIKCREINDFHHANDAYLNIVVGNVYDTKFTSDPRNFIKEYRKNPQKNEYHMYKLFDYNVQRGDRVAWTASNGESMKVVKGTLKKNTPLVTFMSYEEHGGLYDQNIISAKDIEKVKGKGYLPIKSSDSRLNNTEKYGGYAKVSGAYFFVVEHTVKNVRIRTIEPMPCYLTKVLTTKEKIEDYCCNILKYDSPVVKYEKIKMYSLIKVNGYPMYLTGRTGNQLIVSNGIQLVLSYDEAKYIKDLLKINQEEFDQNRLENLGINKFRNEKLYDTLNKKYTNEIYKKRPNSMGNKMIEWKNTFQNLSIKDQTEVLLQLIQLGQKQNSGVNLEKLGASKKTGVSLVSKKITDKESFELINKSITGLYENKVDLLRV

SEQ ID NO: 927 - protein, 1353 aa, Artificial Sequence
  Cas9
MAAFKYYLGLDMGTNSVGWAVTDPNYNLLKAKGKDLWGIREFNEASTAVERRTHRISRRRRQREQVRIGLLKDYFHDAIGEVDPDFFQRLANSKYHLEDKDTEVRYKNNVFNDDDYTDKDYFDQYPTIYHLRKELIESTDKHDVRLVFLALLNMFKHRGHFLNSGLGENSGENNINNAYLELTNLLSEFTQYNLNETIDGKKIEDILSRRDMSRTRKAEGLAEILGVDYKNKPYKELIRGLCGLKFNACAIFPEIQSDEVPKLDICLSEASFDEKSDEIANILGEDYFEIIMAMKDIYDIGSLAGIMKGHNYLSQARVTSYEKHKEDLRLLKNVIRKYCSKEDYDNFFNSEADGSYASYVGSYNSKTKQRRVGNKRSSEELYKAIKKILKNVPAEDADVQRILMSIENETFLPKQLTASNGVIPNQVHAKEIKKILSNAERYLPFLREKDETGLSVSEKIMKLFSFQIPYYVGPTTEKSSKDGGNGWVVRKEEGQVLPWNIDEKIDMKATSEAFISRMVRRCTYISGEPVLPKSSLEYQSFCVLNEINNIKIDGERISVELKQDIYKEVFQKGKRVTKKQLCKYLHTRGIIEAEEQVTGIDVTINNALTTYGKFKAILGDDISKDSVQKMVENIVFWCTVYGDSKKFLKDRIEEKYGEKLTKEQIKRIVGFKFKDWGNLSKNFLELSGADVSTGESVSIIRALWNNNLNLMELINSRLYNYKERLAEYQNTMMKTLSDIEAEDLDEYYFSAPVKRMIWQTILIIKELVKVLGCEPDRIFVEMTRRPDERKMRTESRRKKFEELYKKVKDEDVDWMKVIAHADETGSIRSKKMYLYLTQKGRCMYTGKHIELSDLFNNNLYDIDHVYPRHFVKDDNIDNNLVLVCKEKNAHKSDIYPLEDEILASQKNMWSELRRSGFITEEKYNRLIGRNSFTDEQKAGFIARQLVETSQGTKGVANILQQLLPESKIVYAKASNVSEFRNTRDIPKSRLINEFHHAHDAYLNIVVGNVYYVKFTQNPLNFIKNDYDRDKTKNNYNLSKMFDWDVERNGEVAWIAQKKDGEAGTIATVKKVLGRNTPLMTRYSFEGKGGLTNETLYSAKKAKEEGYIPFKSSDEKMKDVTKYGGFTSVTGAYFFLVEHTEKKKRSRMIESVPLYLAQKIEQNPHELEKYCEQVLGLIDFDIRVRKIKIGSLIKRKGYFFYITGKTGHRLILRNAVNMCLKKEWVKYISKLEKAVDKNNVEGIITKEKNELLYSELIEKFKNSIFSNRPNPVGDKLDEAKEKFINLDIEKQCIVLCQILQLSSVLGSECDMTLLGESAHCGKILISKKIGDEDIYLINQSVTGLYEKKINLRTV

SEQ ID NO: 928 - protein, 1354 aa, Artificial Sequence
  Cas9
MKKILGLDLGTNSIGWAFINEAENEIEVSSIVNTGVRIVPLTTDEESDFKKGNTISINADRTLKRGARRGLQRFKQRREALLETFNRIKFIATDFVYAETGAATTFSSYQLRAKSAVEAVTKEELVKVLLMLNKKRGYKSSRKAKTAEEGDAIDGMKIAKEIFENNLTPGQWVYNSLSKGGKFIPDFYHSDLQKELEKIVRFQNQFHSEQINDKLLADIQGKSRTQTSQHFSKTLNIPLAENKGTREETKLQHYQWRNEALANELDMKILAFIITEINNQINQSSGYLGAISDRSKELYFNQETVGQYQYKQLQENVHAKLKNQVFYRQDYLDEFEKIWETQAKFHSELNEKLKAEIRDITIFYQRKLKSQKHLVSFCEFEKGHKAIPKSSPLFQEFRIWQNLNNVVVKNETTKEVFELSEELKQLIAEELQFKESMTDVQMLTFCELKKGTHTVNFKKIEGNRTNTSIYKAFEKILEVEGYEIDFSKMKPLEIKETVAPIFETLNINTVILDFDPTIQGNDFDKQPYYQLWHLLYSAEDDDKLKETLKTKFGFKENHLPFILNINLQADYGSLSAKAIKKILPHLMDGHIYDKACLMVGYNHSSSLTTAQNNDRVLKDTLELLKKNSLRNPVVEKILNQMINVINAIMKDPAMGKPDEIRVELARELKANNEQRKKATSDINTATTEHERIRKLLHSEFNIPRVTRNDIIRYKLWLETGGISLYTGNPIKASDLFSKNYDIEHIIPKSRLFDDSFSNKTLCERQLNIDKSNKTAYSFLQEKLSENDFAAYENRVKDLFKTGKIKSYTKYKKLLMADNEIPEGFIDRQLRETQYIAKKAKEILLEVSRNVTATIGSVTDKLRQDWELVDVMKELNWEKYDKLGLTHIEEGKNGERLSKIKDWTKRNDHRHHAMDAITVAFTKPAYIQYLNNLNAKTQGENKANSIIGIENKHLYRDKNNKLRFISPMKNFREEAKKQLESILISYKAKNKVVTKNKNTTKKSGGTNQKIQLTPRGRLHKETVYGKLQQYATKEEKVNASFTEDYIQKVAKKEYREALLKRLEENDNDPKKAFTGKNALNKTPIYISLKDNIIVPEKVKTVWLETDYTIRKDITPDLKIDKVIDVGIKRILQNRLNEFNGDPKKAFVNLGESPIWLNKEKGIAIKRVTISGVSNAQALHTKKDHLGNEILDKNGNPIPVDFISTGNNHHVAIYRDEKGNLQEEVVSFYDAVIRRNLGLSVINKNHEKGWEFLFSMKQNEFFIFPSDGFNPHEIDLLNPNNYHLISPNIFRVQKISTKNYMFNHHLETKAVDGEMLKSKKELSKTSYHFIQTPTNLNGIIKVRINHLGKIVHLGEY

SEQ ID NO: 929 - protein, 1354 aa, Artificial Sequence
  Cas9
MKKILGLDLGTNSIGWAFINEAENEIEVSSIVNTGVRIVPLTTDEESDFKKGNTISINADRTLKRGARRGLQRFKQRREALLETFNRIKFIATDFVYAETGAATTFSSYQLRAKSAVEAVTKEELVKVLLMLNKKRGYKSSRKAKTAEEGDAIDGMKIAKEIFENNLTPGQWVYNSLSKGGKFIPDFYHSDLQKELEKIVRFQNQFHSEQINDKLLADIQGKSRTQTSQHFSKTLNIPLAENKGTREETKLQHYQWRNEALANELDMKILAFIITEINNQINQSSGYLGAISDRSKELYFNQETVGQYQYKQLQENVHAKLKNQVFYRQDYLDEFEKIWETQAKFHSELNEKLKAEIRDITIFYQRKLKSQKHLVSFCEFEKGHKAIPKSSPLFQEFRIWQNLNNVVVKNETTKEVFELSEELKQLIAEELQFKESMTDVQMLTFCELKKGTHTVNFKKIEGNRTNTCIYKAFEKILEVEGYEMDFSKMKPLEIKETVAPIFETLNINTVILDFDPSIQGNDFDKQPYYQLWHLLYSAEDDDKLKETLKTKFGFKENHLPFLLNINLQADYGSLSAKAIKKILPHLMDGHIYDKACLMVGYNHSSSLTTAQNNDRVLKDTLELLKKNSLRNPVVEKILNQMINVINAIMKDPAMGKPDEIRVELARELKANNEQRKKATSDINTATTEHERIRKLLHSEFNIPRVTRNDIIRYKLWLETGGISLYTGNPIKGSDLFSKDYDIEHIIPKSRLFDDSFSNKTLCERQLNIDKSNKTAYSFLQEKLSENDFAAYENRVKDLFKTGKIKSYTKYKKLLMADNEIPEGFIDRQLRETQYIAKKAKEILLEVSRNVTATIGSVTDKLREDWELVDVMKELNWEKYDKLGLTHIEEGKNGERLSKIKDWTKRNDHRHHAMDAITVAFTKPAYIQYLNNLNAKTQGENKANSIIGIENKHLYRDKNNKLRFISPMKNFREEAKKQLESILISYKAKNKVVTKNKNTTKKSGGTNQKIQLTPRGRLHKETVYGKLQQYATKEEKVNASFTEDYIQKVAKKEYREALLKRLEENDNDPKKAFTGKNALNKTPIYISLKDNIIVPEKVKTVWLETDYTIRKDITPDLKIDKVIDVGIKRILQNRLNEFNGDPKKAFVNLGESPIWLNKEKGIAIKRVTISGVSNAQALHTKKDHLGNEILDKNGNPIPVDFISTGNNHHVAIYRDEKGNLQEEVVSFYDAVIRRNLELSVINKNHEKGWEFLFSMKQNEFFIFPSDGFNPHEIDLLNPNNYHLISPNIFRVQKISTKNYMFNHHLETKAVDGEMLKSKKELSKTSYHFIQTPTNLNGIIKVRINHLGKIVHLGEY

SEQ ID NO: 930 - protein, 1354 aa, Artificial Sequence
  Cas9
MADFAKYQPGMVADGRKIPLDWTLYYLRKKALTQAIRKEELAWILLNFNQKRGYYQLRGEEEEENSTKHEEYYELKVVSVEAAEEGKGGNTWYNVTLENGWIYRRQSKIELNDWVGKVRPFIVTTEYEIDGVTIKKDKNGEVKRSFRAPSENDWGLRKKRTESLLEESGKTVGAFIYNHILSEPADKIRGNFIRTIERKFYKKELEAILREQSKHQKELKDIDTLIACIKELYPNNKPHQDSLIKKDMTYLLITDLIFYQRPLKSKKSLIADCPYEYYEYVIKETGENKRQSIKCIAKSNPYYQEFRLWQFIINLRLFDRNNDKEVTSEYLSSMEDYTRLFTYLNDRKDINQETLLKDFFKQKKVKRGMEKEFPIRWNYIEDKEKKYPCNETRHELLTALGKVGIDHSWLDDKELFYRLWHLLYSVESKEEAEGALRKLVDNDDFVNAFLKIKPFKKEYGAYSEKAIKKLLAVMRMGNLWNEVDICEQTRDRIQNIIKGDIDEKIKDRMGRTFSQLSDFQGLPEWLACYVVYGQHSEATDIQRWTKPENLMAYINGFKQHSLRNPIVEQCILETLRTVHDIWKEAGHIDEIHIELGRGMKSTADQRARMSKSIMQNENTNLRIKSLLMELKNAKEFENVRPYSPMQQEILRIYEEGALQELTKEDAQYNEISKISQMAQPSANELLKYRLWLEQKYCSPYTGKPISLSKLFTSAYQIEHIIPQSRYFDDSFTNKVICEAEVNQLKSNMLGYEFIKKHGGEIVRCTMIGDVKLLDAKEYYNFVTEHYTNNRRKKEKLLMEDIPQEFLNRQMNDSRYISKKVMAILSNIVREEDEQEAKSKFVIACSGGITDRLKQDWGLNDVWNSIVYPRFERLNKLTNTENFGRWENKKGKQVFQTSVPLELQKDFSKKRIDHRHHAMDALVIACASNNIINYLNNESAKSQEKREDLRKKLCDKNRIIRKPWETFTQDAHTALENVVVSFKNYIRVINKATNYYEKYDKNGKKEIAEQKGQDMWAIRKPMHKETVFGQVNLRRKITIKLKDALEKIPAICDKELRDYINILVAKQFNKKQILAHFKSINYRLNMKSVDKVDVWQFSNEKEPMVATRKSVDTSFDTKRIATITDTGIQKILLNYLKAKNNDPNIAFTPEGIAEMNKHITEYNNGKQHQPILKVRVSEPKGAKYQVGETGNKRSKFVEAQKGTNLYFAIYEDKEGNRSYNTIPLNEVIERLKQGLSPVPDANEKSIPLKFHLSPNDLVYVPKTDEENEIKMGQIYKFVDSSGTTANFVPHRVSNLIYNVDKKIAENFCNHEIIQNEYGIGSPQSKNQKSITGEMIKAVCWKLEVDRLGNIHKIIK

SEQ ID NO: 931 - protein, 1354 aa, Artificial Sequence
  Cas9
MKKILGLDLGTTSIGWAFIKEPEKDVVGSEIVDMGVRIVPLSSDEENDFAKGNTISINADRTLKRGARRNLQRFKQRRNALLETFKEKNLIPSNFQYAEDGPSSTFSTLKLRDKAAKEKIELDDFVKVLLQINKKRGYKSSRKAMSEEDEGTAIDSMGIAKELYENDLTPGQWVYEALKNGRKNVPDFYRSDLQEEFKKIVNYQSEFYPDILNTSFVEDWMGKASTPTKQYFNKRGVQLAENKGKREERRLQEYKWRAEAVNFKIDLSEIALILSQINSQISNSSGYLGAISDRSKELYFKNLTVGQYLYQQVKKNPHTRLKGQVFYRQDYLDEFEKIWSVQSSFYPQLNDELKQEVRDVTIFFQRRLKSQKHLISNCEFEEHHKVVPKSHPIFQEFRIWQNLNNLTLIKKDNLNEKCELALEDKTALANELAFKKELSVKDALKVLGLKPSDWEFNFTKIEGNRTNHAFFEAFAKIIELEDGEPIDLGNLKADDILDQFSEAFLRIGIDTELLQVNSDIEGAEYEKQSYIQFWHLLYSSEDDQKLKQNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPNLGRPDEIRVEMARELKANAEQRKNMTSNIASATRDHEKYREILKKEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEITMRVSVTTGTITDKLREDWGLVEIMKELNWEKYDKLGLTYTIEGKHGERLNKIKDWNKRNDHRHHAMDALTVALTKPAYIQYLNNLNAKAIGNKKGTEIFAIEQKYLKRENGKLCFIPPIENIRAEAKKHLSKILVSYKAKNKVVTINKNKTKKKAGFNEQTALTPRGQLHKETVYGKSFHYSTKFEKIGASFDAQKINTVAKKEEREALLKRLAENGNDPKKAFTGKNSLNKMPIYLDLGKNIKLSEKVKTVVLEQNYTIRKNIDPDLKVDKVIDVGIKRILESRLEEFGGNAKLAFSNLEENPIWLNKEKGIPIKRVKISGVSNVESLHVKKDHFGEKILDEEGNEIPVDFVSTGNNHHVAIYEDEDGNLQDEVVNFYEAVIRRNQGESIIKYRHEEGWNFLYSIKQNEFFVFPSQDFNPNDFDLLDPKNYDLISPNLYRAQKFSKVMYGNSAVRDYVFRHHLETVLNDVKELKDVAYKQLKSLQYLNGIKKVRLNHLGQIIQVGEY

SEQ ID NO: 932 - protein, 1354 aa, Artificial Sequence
  Cas9
MTLHYNVGLDIGTNSVGYTIVDDNGKILQVKGKNGYGVRVFKEGATAAERRIFRTTHRRLKRRKWRLRLLQDFFEPYILPQDDGFFIRRKESNLVLNDRDEDTASLFNDRSDRDFYQAYPTIYHLRQALMTEKRQFDVREIYLAMHHIIKYRGHFLLNGTVNNFTNNKIDLHSDFEELNALLLNVIPELKFQIDLDHSTMFQTTLLNTTISRSGRQRDLVKSFYNGSDDKQLAKQQKSVATELLKAILGLKAKFHKLFNLDLLETTEWEFSFDAEDIDDKLAKLEPLMTENQQQVMDILQRIFAAITLNGIVPEGKTLSASKVDSYQKHKQDLKLLKAIAQHSDKKTATVLQTAYNEYINGIASKPLKQEDFYKRLTNAVKKSSDPQVADMLALIDQEKFLPKQRTKENGAIPHQLHQLELERIIDNQKDYYPWLAELNPNQARQKVAKYKLSELVAFRVPYYVGPLIEPEVQQATSNAHFAWMARKEAGPITPWNFDQKVDRNVSAERFIKRMTTKDTYLLAEDVLPLHSLLYQRFIVLNELNNVRVNGQKLTKKQKQAVYQDLFKRQPHVTKKQFKSYLVQTGEFAESSKIEGLANETSFNSGLTTENELRKIFGAQLDEARYQVDFEQIIEWATLFEDAKILRTKLAEITWLTTEQIEKLAGIRYRGWGRFSRKLLAGLRDQNGQQIIDLLWDTPNNFMVIVSQAAFSEAITKENEKLIDRRGAQDVITDLYTSPQNKKALRQVLAIVADVQKAMGGVPPQRIFIEFAREDEKNPRRSVERSRQLEKLYQTISNEFLINSEVRQELKEAVDQKVNFKDRLFLYFLQGGVDLYSGKRINIDQLSHYDIDHILPQSFIKDDSLDNRVLVSQKLNRSKSDSVPLSEFANYKFGPAMQAKWLQLKEAGLLSKRKYDNLTLDPTKLSKFAPLGFVNRQLVETRQVIKLAANLLASEETKVVTIKANMTHQVRKELDFPKNRNVNNYHHAFDAYLTAFVGIFLSKRYPKLKPYFTYGDFQKGNKLPDLKNFNFLYELKNKDRSIDSNTGEIIWDKQRDLAYMNKIYNFKKVTVVHEVLTKSGALYNQTLYKASEDKASGRGTKQLIRKKDNMPTELYGGYTGSTSAFMSIVRLWKKDKPYYKVVGIPTRMAAKLANQAQLLDYLTKKFTTRKLVKKTGDYKTTVERFELVVPKVGFNQLVIDGGQPFMLGSATYQYNARELFISKEAVKALNKQLSTHVDLVQVFDEILVQVNRWFPLYDTNGFREKLSHGRDRFMKLNDSFEEKSDTQIDVLNRILIGFHANAARTNLKILGLGTDLGFMTQQAGIRLTEKAILVHQSPSGLFERKVALRDLKGLR

SEQ ID NO: 933 - protein, 1355 aa, Artificial Sequence
  Cas9
MTYSIGLDIGTGSVGWAVIGDDYRLKRAKGKNLIGVRLFDSATTAAERRGYRTTRRRLSRRHWRLRLLNDIFASDLAEQDENFLPRLKYSWVNPDDEQNPQLNSDVANGALFGSSETDKAFHKNYPTIYHLRHELMTDTAKHDLREVYLAIHHIVKYRGNFLNTADKINAENSFNVDLFIAALDEYNEFLETPITSIKDAQLFSDKLTDINARNKSVRVENAMSETYDDKSKIFKAILTALVGNTANFQTIFDLSDLEKDEAKNFKFKLDLEDVETKLDVVRAKLSDEQNAFLEAVLIAYDGITLKMILGDYKSISQSMIESYKSHQRDWKYIKNNVRLNEQKIEPDKNSVKFFKLDPKKLIYPSNLAYLQVISSNEDEHRKGLDYFKTAIQDADILQRIENDTFLPRQRTKRNGVLPYQLHLAELEQIIKKQSKYYPFLANIYTQDNKTENKLIGLLKFRVPYYVGPLVEAEKVTGDGKNHWLIKKELQENTPITPFNFDDVVDKDKSGEQFIKRITGTDSYLIGEPTLPENSLLYQKYNVLQELNNVRNERHQRLPIKVKQDIFEHVFKIDKNVNAKKVMAYLKLNGYGDFQIAGLSDTRTGKFNSNLSSYNYFVDLLGREKTEKIREDRLEEIIEIQTVFEDKILVAKRLSNLDFLTPQEKSKLSAKHYTGWGRLSQKLLTTQFIKTALSEAGDIIPQSHSIIDLLYYTDKNLMEILNDKTFNVRNWLTEQNKGTESGNSLYDQIDALAGPKDIKRGITQVFSIIDDIKKAMGSNPETVYLEFARETQTSRLTNSRLNRVQEIYNSPELKTEFAYLAKKLEAETKESIHDDRLYLYYLQEGRDMYTGKEIPFDQISSNYDIDHIIPQAFTKDDSLDNRVLVNRATNARKSNSPTFTNDIIDNRKSWWQSLVKRGLMSKEKFERLTDKRKTFSENQTNHFIARQLVETRQIIKNVADLIKNNYDGTQAVAIRASLTGEMRRYLDWPKNRDMNDYHHAHDALMMATVGKYVDRRGFFDNGSVSDGAGNAYNLYTKDWLVAARVGTRNDSQRVNPYGFIVGSMNSKAVRQQVNKETGEIVWGNENLDYLRHVLSYKKILVTRRLSGSSGRLYAETLFSPNPKAKLIAQKANRSVALYGGFTKAESAYTALVEFNKKGDRSYKLIKVPMAIANRVNDKQITVTAYIASLNLRDFSRVVLEHLPLGTLIRESDGSEFYAASSEYKHNAKELWAPKEILRSSKKLDKATADNLIDIFDFLTNDKTISNFKFYEKDLLHLKNVRDKFVEASDEIKIKVLSDVIYELHNDAGWRDPFKHIQEKPAWTMLQVKGGIKLSEKAAIVYQSPTGLFETITIVGE

SEQ ID NO: 934 - protein, 1356 aa, Artificial Sequence
  Cas9
MKKFEEYYIGLDMGTGSVGWAVTDSAYNIIKRHGKALWGIRLFESAKTAEERRIFRTSRRRTERRKNRLHLLQEIFAEEISKKDMGFYQRMKESKYWHEDKKDINGNMPELPYALFADDGFTDKDYYKKYPTIFHLRYALATNTTDKPDIRLLYLALHHIIKHRGHFLFEGKKLSEVKEFSTAIEALVQQAEEQEIDLKSLTQEEVLTQLEHIMSDAQCTKSDKKTQVSKLIVGTDKQKQKQEKAIAALITGCTVKLSDIFADPELDKEEISKICFSDNGYEEKEVEIESVLADRFLLIAAAKGVYDWTVLHDILGDARFLSEAKVKTYEKHRDDLRKVKQLLRMDKEVYEAVFGVSEKNEANYSAYIGMAKKNGKKQPIEKKCSQEDFYKFLKKQLDRLSVDEMGQEIIDELKAEMDLGTLFPKQMIRDNGVIPYQLHENELNAILDNAQKFYPFLLEKDQDGYTPVEKIQKIFRFRIPYYVGPLNTAHQDKGGHSWSVRKKEGKIYPWNFSEMIDEEESATKFIERMTNKCTYLIGEDVLPKESLLYAKFNVLNELNNLRIDGELIAPELKQDIYNNVFKKYQRVTGKKVKDYLRINGVISKEQELSGFDQNFKSSLKAYHDFKQIVGTGVLSESEQEDIVRDITLFADSQKMLKQRIHRKYPMLSDKQIAQLANKKYAGWGRLSRTFLENIESVNKETGEVMNIITALWETNENLMKLLSGKYDYTKQIEQWNARQMKKGEIEYQDIEELYVSPAVKRPIWQTIKIVREITNIMGGAPKRIFVEVAREPGEKGVRKVSRRNQLLDLYKACKKEAPELYDRLANKESDNALRSDKLFLYYSQMGRCMYSGDAIDLDELFTNRYDIDHIYPQSKVMDDSIDNRVLVKRDLNSKKTDTFPVSEEYRKAGKALWSTLLKKGLISKEKYKRLTRTEPFGEDELAGFIARQLVETRQSTKAVAHLLEEAYPDAEIVYAKARAVSEFRHKFDMIKVREVNDFHHAKDAYLNIVVGNTYYVKFTKDAAWFVRNNPGRTYNLKKMFENETVKRGNETAWIPGDNGTICTVKKWMRKNNVLFTRRAYEVKGGLFDQNILKKGKGQIPIKGGADERLRSRDKYGAYNKASGAYFMLVESDGKKGERKRTIEFVPVYLAKSLEESVELRRRYCEEELGLVNPDVRLSKIRKNALIDVDGFKMHLVGRTENRLLLIGATQLVLSEDDQQLIKKIGKYCLDHRENKDAVLSEKYELTMDLFEKLYDIFVFKLEQTVYAVKLSKQAKDLKEVKEEFLALDDEQKCLLLMEILHLFQCSPQLANLTNIGGGKSAGSLKILSDITKQQSVLLINQSITGFYEQVIDLKTI

SEQ ID NO: 935 - protein, 1356 aa, Artificial Sequence
  Cas9
MEVGNYYLGIDAGTDSVGWAVTDNQYNVIRKKGKSLWGIRLFDGANTAQERRTFRALRRRNERKKQRINLLQELFCKEICKLDPNFFIRLRDSSLWSEDKEEKQIYSLFNDKNFNDRNYHNNYKTIYHLRADLIKNKEKHDARLVYLAIHHIMKNRGHFLFNGNIESVTSFENTFNEFKNCLLDELEINLECPSISEFENILKDRTFKGTQKCKKLKELCSIPSSDKKLDNIFKLISGLKADLSIIFEDESFKENEHNKISFADSNYEETREVLNSEIQEKTLIIDIFNSIYNWVILSDILSGGEYNGGLYLSIAKVNTYNKHSKDLKILKSVIKKYFPQKYTDIFASNKENNYCSYIGMYKSGGKKYSVKKCSDKPEEFYKTIKNIINKNTAEEISNDKDVQYILSEIENNSFLPLQINKNNGVIPYQANKIELESILKNAENYLPFLKEIDTECNKTTSEKIIDLFEFRIPYYVGPLNTSKGENAWMIRKEDGTIRPWNFEQKVDIDKTAAEFITRMTNQCTYLNNETVLPKYSLLYSEYTVLNEINNIRINGEKISVELKQDIFNILFKNNKQVTCKKLLSHLNSNGYNLKKDDLSGFDGNFKSSLSSYIDLKNYIFGDNIDKPQIYNLAEKIILWITLYGDDSKLLKRVLQKNCSEQLNPEQIKKITKLKFKGWGRLSKAFLSELRGADRETGETMTIIKGLRNTQNNLMQLLSQNYTFTEECEKINSGYFINPNEISYDSIVKNIVASPSIKRSVWQTIQIVEEIQKVMGSKPRKIFVEMARGEEEKVRTTSRKQKLLDLYKNISDECAKGMYDEIYSKDESDFKNIRLYLYYTQMGCCMYSGKHIDLSQLSNTNIWDRDHIYPQSKTKDDSLDNLVLVYKSINSEKSDDIISPTIQNNMRTFWKLLFDRKFISEKKYHRLTRTTPLTDEELAGFINRQLVETRQSTKVMASIFKRIYPNTEIIYVKAKNVSDFRHRKDCENGVKVRELNDYHHAKDAYLNIVVGNVYSSKFTNNPLMWLKNNRNVKYSLNRMYDFNLTVNNENIWVVGNEGTQKTVNKYLGKNDILYTRYAMTNKGELFDQNPLKATGDKSKQTTLVPLKKGKEVWKYGGYNSITPSYFMLVESKDKKGNYIRTIETMPLYREKEFSKNEEFLLNYCKEVHKLKEPKIILKCIKKNALLIVDGFPMHLKGSTGLQLKLQGAVQLILESDMVIYLKKLMKFVNENNINKNKLEVTPYMELSAKENIKLYDIFIQKLTTGIYSKRPANPVEKLINARDIFIELTVKEQCIVLSEILHLFQCKPLTSANLVSINLKKTVGIIQIAKNITAKNVKLVHQSPTGIYEYTVDLNKI

SEQ ID NO: 936 - protein, 1356 aa, Artificial Sequence
  Cas9
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 937 - protein, 1356 aa, Artificial Sequence
  Cas9
MTKKEQPYNIGLDIGTGSVGWAVTNDNYDLLNIKKKNLWGVRLFEGAQTAKETRLNRSTRRRYRRRKNRINWLNEIFSEELANTDPSFLIRLQNSWVSKKDPDRKRDKYNLFIDNPYTDKEYYREFPTIFHLRKELIINKNKADIRLVYLALHNILKYRGNFTYEHQKFNISTLNSNLSKELIELNQQLIKYDISFPDNCDWNHISDILIGRGNATQKSSNILNNFTLDKETKKLLKEVINLILGNVAHLNTIFKTSLTKDEEKLSFSGKDIESKLDDLDSILDDDQFTVLDTANRIYSTITLNEILNGESYFSMAKVNQYENHAIDLCKLRDMWHTTKNEKAVGLSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSSEKNPFAWMERKSNGHARPWNFDEIVDREKSSNKFIRRMTVTDSYLVGEPVLPKNSLIYQRYEVLNELNNIRITENLKTNPTGSRLTVETKQHIYNELFKNYKKITVKKLTKWLIAQGYYKNPILIGLSQKDEFNSTLTTYLDMKKIFGSSFMENNKNYNQIEELIEWLTIFEDKQILNEKLHSSNYSYTSDQIKKISNMRYKGWGRLSKKILTCITTETNTPKSLQLSNYSVLDLMWTTNNNFISIISNDKYDFKNYIENHNLNKNEDQNISNLVNDIHVSPALKRGITQSIKIVQEIVKFMGHAPKYIFIEVTRETKKSEITTSRGKRIQRLQSKLLNKANGFKPQLRKYLVPNEKIQEELKKHKNDLSSERIMLYFLQNGKSLYSEESLNINKLSDYQVDHILPRTYIPDDSLENKALVLAKENQRKADDLLLNSNVIDKNLERWTYMLNNNMMGLKKFKNLTRRVITDKDKLGFIHRQLVQTSQMVKGVANILNSMYKNQGTTCIQARANLSTAFRKALSDQDDRYHFKHPELVKNRNINDFHHAQDAYLASFLGTYRLRRFPTDEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREIANRQQLILPPEHSALLRILQIPDEDPDQILAFYDKNILVEILQELITKMKKFYPFYKNEQEFLASNIENFNQATTSEKINSLEELITLLHANSTSAHLIFNNIEKKAFGRKTHGLTLNDTDFIYQSVTGLYETRIHIE

SEQ ID NO: 938 - protein, 1356 aa, Artificial Sequence
  Cas9
MSKKDSEYYIGLDIGTNSVGWAVTNGKYDLLNIKKKNLWGVRLFEAAESAAGRRINRSTRRRYRRRRNRINWLNEIFADELSKVDPSFLTRLNSSWISKKDSSRTRDKYNLFMDADYTDKNYHHKYPTIYHLRRDLMFDDKQFDIRLVYLALHNIIKYRGNFTYDHRKFNVSEMSSNLTKALENFNQELMEFEDAFPDNTDYSAISEVLLKSNNVSTKIDEIISNLELDKDTKKYLKEVLKLILGNSANLNTIFHTSLDKDDEKLSLSAKDIELKLNNLDSLLSDEQIHFISSANELYSSITLNDILDGKTYLSLAKIKQYDTHCSDLQELKEMWYKTTNPDLIKKSRKAYKEYVHGSYNTEDFYKAISPFLKIAIPEDLAKDALKKIDANTYLPKQRTSNNGVIPFQLNLIELEKIIDNQSKYYPFLKENREKIISILSFRIPYYVGPIQAPTDKNFSWMVKKIQAKARPWNFDEVIDREKSSNNFIKRMTTTDTYLVGEPVLPKNSLIYQKFEVLNELNNIRISKNLSQDPLGSKLSVEVKQQIFEELFKRYKTVKSDQLKKWLIRNSYFTDPTIIGLSKPSEFNSSLSTFIDMKAIFGMDFVNNPRNSSQLEELAEWLTVFEDKQILSEKIRHSNYPYSDQQIRKISNMRYRGWGRISKKLLCDIKVESTIYKSHQLHPYSILDLMWSTNNNFYSILHKDKYNFESILEDYNLGTDDKTDINELVDNIHTSPALKRGIIQSINIVKELVKFMGHAPQHIFLEFTREDKTSTLSESRKKRLKKLYNNLSEDTKKFKLDLRDYLVPDKSIQKELESHDKDLSKERLMLYFLQNGKSLYSDEALDINRLSEYQVDHILPRTYIKDDSLENKALVLAKENQRKADDLLLQPSIINKNMERWIYMKDHGMISPKKFKNLTRTTITEDDKVHFINRQLVQTSQIIKNVANILDNMYKEQGTTCVETKANLSSAFRTAFSEQDDKYHFKHPEFIKNRDVNDFHHAQDAYLACLLGLYRIQRFPSDEMLLIKKEYRKFFAQAQNSVKNHGKIPDSQKNGFILAPLVNGETLINNKTMETIWNMDYKRKVIKIFNYKQYNITKRTEIKTGEFYKQTLYSPHDENVKNPIPQKKNLDPKIYGGYSGVQSSYLAIIKVDQKKPTMVSVPIRFSKMIDDGKLSLQSWLENNIKHKKTIEVLKTKIPIGQLTYNPKNGYLSVQSEKEIANAQQLFLPFEHVALLTLLHAPTSEYDQILSFYDTDILLEIFDEITNKIKTFFPFYIDEQEYLVSIRENFQSATVIEKVNVLQQLLIMLHANSSRISIKLGEVSKKDLGRKKKRIPLENTDLVYQSVTGLYQTKFHID

SEQ ID NO: 939 - protein, 1357 aa, Artificial Sequence
  Cas9
MNDRNKKYNIGLDIGTGSVGWAVTDNNYNLLHAKKKNLWGIRLFDGAETAASRRTFRSTRRRYRRRRNRINWLNEIFADELAKKDQSFLVRMNSSWVSKKDKIRQRDQYNLFMDSDYTDVEYHREFPTIFHLRKRLIEDKSQADIRLVYLALHNIIKYRGNFTYEHQNFDVSHMDSGLALLLNQLNQQLQAFEVAFPDETNFESMSTILLEKKTPTQKIDEIVDQIQPEKDLLQITKNIMKMLLGNKADLVKIFSLDSDDKITVEFSSNSIEQDLSNLEETLSDEQFNIITLANSIYSSIVLNDILSGETYLSFAKARQYSDHKKDLAKLKTMWRESPDRKAVGKAKKAYDDYLHSGKYGIEDFYKDMSKFLETATPVELAKEANEKILNKSYLLKQRNNENGVIPFQLNKNEMIEIINNQAKYYPFLAENKDKLLSILSFRIPYYVGPLQSKKDNPFAWMEKKSQGKIRPWNFDEIVDREASSNNFIRRMTSTDTYLIGEPVLPLKSPIYQKYEVLNELSNVRINADEVDNPLGDKLSVDLKQAIYNELFLKHRSVSKALLTKWLINQSYFQNPQISGLADSKKFNSGLTTYHDFKKIFGEDFVNDPTNQSQLEQLAEWLTIFEDKKILKIKLDDSQFNCTPEQIKKIAGMRYQGWGRLSKKLLCDIKTTTVTSKNHQQASYSILDLMWNTNRNFISVLKNDTYKFEDKIQTFNLDKNEAATPQAMIDELQTSPALKRGIRQSVTIIQELVKFMGHAPEHIFLEFTREDDVSSLTKSRDSRLNKLYARIAKNTKKTDDELKKSLLPSSDIKATLKANKNNLSNDRLMLYYLQMGKSLYSNQPLDINRLSEYQIDHILPQSYIKDNSLENRALVLASENQHKSSDLLLKPEIINQNIARWRYMKDAGLMGPKKFKNLTRIQITDSDQNNFINRQLVQTSQIIKHVSNILDSMYGDQGTQCVETRAHLSTEFRKAFSNEDDNYHFQHPEFVKNRNINDYHHAQDAYLACLLGLYQMKKYPTDNMILLKKEYKRFFSNTKKIYDKKHHFPDYVKNGWIIGSMFNGEKYVDEETGQIIWDQQTKDMVSCIFQYKQYNVTKRTEAANGEFYNQTVYKKDPNEKRKLISLKQGLDTKLYGGYSGDNPAYIVLVKIDDKKNKLVKMPIRLAEQVDNKTIDLQTWLEENVPHKKGIQVLKTKIPLGQVIYSKKNGYLALKSDTEIVNAQQLVLPYGYVALLTLLQKMPENKYDEVLACYDDGILDNIFVAIIDKMKHFYPYYSGELKTLSDNIDNFKESPDVNKIKTLQQLLLLLHASSTTASIEFNNVKKNSLGRKPNSINIQNTDLLSFSATGLYESRIHID

SEQ ID NO: 940 - protein, 1357 aa, Artificial Sequence
  Cas9
MAAKNYNIGLDIGTSSIGWAIVDDNYQLMHAKGKYGYGTRIYSEGQTAADRRGFRTTRRRLNRRKWRLRLLQDFFEPYILPQDEAFFIRQKQSNLVPQDTKKQYPESVLFDDTSDKDFYTEYPTIYHLRQALMTENRQFDIREVYLAIHHIVKYRGHFLNNAPVKTFKSGNLDLAIKFNELNEEFKSVYPDLELQFNLDQIDEIKKILLDSTKSRFDRQGEAVKLIYTVSEVKTIEKLQNKIVKQFLSGILGLNTRFDVLTNTESDDSMWKFSLDSESSDDALDEIIAQLDDPAIHVVELVNEIHSSITLAGIVPEGQGLSESMVEKYEAHKAHLQLLKAVEKLVDKKAADKLEVAYDQYINGKDSKQFIKEDFYKAVQSEIKGVAGDEVAEINQLIELDQFMPKQRTKENGAIPHQLHQHELDVIIENQSKYYDWLGEKVGNEYKLDKLVSFRVPYYVGPLVDTASKEKKDETRFAWMVRKNPESTEAITPWNFEDIVDKNASAENFIKRMTTKDKYLLNEDVLPKCSLLTQDFEVYNELNNIRVNGEKFTAEQKQLIHDELFTKHASVSIKQLKDFLVSELMYVRDNLKVEGLADEKKLMSSLSTQFDYQKIIPDQINDVKYREDIEQIIEWSTIFEDAAIFKTKLKEIDWLTDEQRNKLANKRYRGWGSLSKRLLACLVDENGQRIIDILRDSSDNFMMIVNRPEFKQAIFDENANLTETNSKKDMFEMIDNFYTSPQNKKAIRQVLLVVQDIQNAMGGVAPQKIFIEFAREDEVNGRRTNSRYSQIREMYSKVTDDVINKTVRGELEANKGSLNKEKLFLYFLQGGIDLYSGKTINIDNISSYDVDHVLPQSFIKDDSINNKVLVNAKGNRVKNDNVPMELFGAKMYPTWKRMVDTGIMSKAKFKNLTLNPDNVDKFKAEGFINRQLVETRQIIKLVAQILNDKLGDDTKIVSVKANLTHDMRVFFDFPKNRNVNNYHHAFDAYLSAFVGTYLYKRYPKLQPYFVYGEFKKMDKLKNMTSFDFLRDLKHTDKVVDKDTGEIIADKLAVITNMNKIYDFKKVLVTHEVHENSGAMYDQTLYPAKLDKSLGRKGAKQLIPKKDDMPTALYGGYTGSKDAFMSIVRLKKKDEVYYKVIGIPVRIADSVQHGKEVDVEALTQFIETKFTKENLNKKTGEITRKVEWFELVLPKVLFGQAVFDGGQPFMLGSSTYPHNLRELVLTKDSVKKIAGKESNKSYLDAYDEIMEAMNKYFPLYDTNKFREKVIEGRSKFIDLPDKDEYENNKLVQVGKSTIIDRMFIGLHANAARTDLKNIGITTPFGFMQQASGIKLTKDTVVLFQSSTGLFERKVALKDL

SEQ ID NO: 941 - protein, 1358 aa, Artificial Sequence
  Cas9
MKEPYGVGLDIGTNSVGWTVVDASGHVRKIKGQTGIGVRLFKEGAAAADRRGFRTTRRRLKRVKWRLRLLREFFDQPISKVDINFFARRKYSDVSPRDPNYNGLEKTLFNDRSDQDFYHDYPTIYHLREALMTQHRKFDVREIYLAIHHIVKYRGNFLRNDAATAYRSGTLDLQQHFETLNHLFSQADLELNLNLTTDVALLDSIKQTLVRTDISRSDRQKLIMPLLAVLTGATTAEKKRQKAVVTEFAKALVGNKTKIDVLTLTDIDATEAKDWAFSLEENQDKLPGIEDRFSEVGQQIIDEVIRLYASVNLAQLIPEGKRFSQSMVEKYKRHGEDLKLLKAYIRSQSDAKRGRAIRATYDQYIDGVKSKQVTQEAFQKALGKFVDADVDLNSWAAQIKQAIDSEQFMPKLRTKQNGAIPYQVQQNELDQIISNQKEYYPWLGEENPVIKRRGKFPYKLDELFGFRVPYYVGPLITKEMQAATANAGFAWMVRKADGPITPWNFDDKVDRVASATAFIQRMQTTDTYLIGEEVLPARSLIYQRFMVLNELNNIRVDDGQLTPRQKQRLYNQVFKKHKRVTAKNIQDNLVAAREFPTAPRITGLADPKVFNSSLSTYHDLKQVLPEAMSDVRKQADIEKIILWSTIFEDSTIFKQKLTEISWLTAAQLKQLGQLRYRGWGQLLRKLLTGLKDDNNRSIMDGLWETNANFMQLRSQPAIENQIKSANQANLTTADLQDTINELYTSPQNKKAIREVMVVLADIKDAMHGQTPNWIFVEAARGGGVAGRRTQSRSKQIVAAYQGTAQAIVRDQVQRELKEKIKNKANFNTRLVLYFLQNGRDLYTGDAINIDRLSEYDIDHILPQSLVKDDSLDNRVLTNARINREKNDTFASEKFGKKMGAKWKEMHRMGLMTKRKLDHLLMRPDEISKYATGFINRQLVETRQVIKLVEELINAEYPSTAIVSVKANLTHQFRQTFDFPKIREVNDYHHAFDAALTAFIGTYLLKRYPKLERFFVYGKFAKQPVNLTRFNVIRKLAKTDTPITDIDTGEVLWDKLTDIKYFETLYDYKRLLVTREVSENYGAMFDQTLLKASDNGKRLIRKKQSFDTAIYGGYTGKTLAYMAIVKVSTKKDVQYQVVGVPTTMVTQIEQLEQQGMTNKQAVTKVIEPLIAANNKKMLTYEVLLPKVRFEQVVRDRIKGQTHRFALGTDTYYHNIQELYLPLTLQRAFLGKQNESEVQLNQNLLTVFDATLAQVNRYFPLYEMNKFKKILNSARDQIELLEAKNQFVKNKLVLGKQGILTNMFIGLHANASYGDLKVLGVKIDFGKLQVPGGIKLTGDAEIIYQSPTGLFERKIALKDL

SEQ ID NO: 942 - protein, 1358 aa, Artificial Sequence
  Cas9
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDQEFYHDYPTIYHLRDKLMTSDRKFDIREIYLAIHHIVKYRGNFLRTGPASQYGSASLHLATSFQKLNDLFAQSEESLNFKLVTDEAQLQQIQQILVRTDLSRSEQQRQIWPLMVVLMGATAAEKKRQKDFAKELANALVGLKAKLNVVTLTNVDTTVVKDWTFTLEESQDKLPEIEEQLSEVGQQIMDEVIQLYASVNLAQLIPAGKRFSQHMVEKYNHHEKNLELLKAYIHSQSDSKRGREIRATYDRYIDGVKSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDQKLAPRQKQRLYNQVFKQHQHVSVKNIQQNLMDAGEYRETPKITGLADPKGFNSSLSTYHDFKKILPEAIADEHKRADIEKIILWSTTFEDSAIFKQKLEEVAWLTDAQRKQLSGLRYRGWGQLSHKLLTAFKDDNGRSVMDGLWETSDNFMQLRKQPAIETQIKEANQANLTDADIQDTINELYTSPQNKKAIREVMLVLDDIKNAMHGQTPSWIFIEAARGGGVAGRRTQSRSKQIVEAYKSTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPSASIVAVKANLTHQFRQTFNFPKLREVNDYHHAFDASLTAFIGMYLLKQYPKLERFFVYGKFAKQPINLTRFNVIRKLAVAEEPIANIETGEILWDKTADIKCFEKLYNYKRLLVTHEVRENYGAMFDQTIFKATDSRKRLIQKKKGFATETYGGYTGRTLAYLAIVKVVTNKDTQYQVVGIPTTMVTQIQQLEASGLTSKQAVTKAIGAMINENNKKLQSYEVLLPKVRFEQVVRDEVKGHIHRFALGTDTYYHNIQELYLPLTIQRAFLGKRNDTDAQTEQNLLTVFETTLAQVNRYFPLYEMNKFKQILNSAQEKFAALPTKNKTVKNKLVTGKDGVLNNLFIGLHANASLGDLKILGMKTGFGKLQVPGGLKLTDQAEIIYQSPTGLFERKVALKDL

SEQ ID NO: 943 - protein, 1358 aa, Artificial Sequence
  Cas9
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDQEFYHDYPTIYHLRDKLMTSDRKFDIREIYLAIHHIVKYRGNFLRTGPASQYGSASLHLATSFQKLNDLFAQSEESLNFKLVTDEAQLQQIQQILVRTDLSRSEQQRQIWPLMVVLMGATAAEKKRQKDFAKELANALVGLKAKLNVVTLTNVDTTVVKDWTFTLEESQDKLPEIEEQLSEVGQQIMDEVIQLYASVNLAQLIPAGKRFSQHMVEKYNHHEKNLELLKAYIHSQSDSKRGREIRATYDRYIDGVKSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDQKLAPRQKQRLYNQVFKQHQHVSVKNIQQNLMDAGEYRETPKITGLADPKGFNSSLSTYHDFKKILPEAIADEHKRADIEKIILWSTTFEDSAIFKQKLEEVAWLTDAQRKQLSGLRYRGWGQLSHKLLTAFKDDNGRSVMDGLWETSDNFMQLRKQPAIETQIKEANQANLTDADIQDTINELYTSPQNKKAIREVMLVLDDIKNAMHGQTPSWIFIEAARGGGVAGRRTQSRSKQIVEAYKSTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPSASIVAVKANLTHQFRQTFNFPKLREVNDYHHAFDASLTAFIGMYLLKQYPKLERFFVYGKFAKQPINLTRFNVIRKLAVAEEPIANIETGEILWDKTADIKCFEKLYNYKRLLVTHEVRENYGAMFDQTIFKATDSRKRLIQKKKGFATETYGGYTGRTLAYLAIVKVVTNKDTQYQVVGIPTTMVTQIQQLEASGLTSKQAVTKAIGAMINENNKKLQSYEVLLPKVRFEQVVRDEVKGHIHRFALGTDTYYHNIQELYLPLTIQRAFLGKRNDTDAQTEQNLLTVFETTLAQVNRYFPLYEMNKFKQILNSAQEKFAALPTKNKTVKNKLVTGKDGVLNNLFIGLHANASLGDLKILGMKIGFGKLQVPGGLKLTDQAEIIYQSPTGLFERKVALKDL

SEQ ID NO: 944 - protein, 1358 aa, Artificial Sequence
  Cas9
MKEPYGVGLDIGTNSVGWTVVDASGHVRKIKGQTGIGVRLFKEGAAAADRRGFRTTRRRLKRVKWRLRLLREFFDQPISKVDINFFARRKYSDISPRDPNYNGLEKTLFNDRSDQDFYHDYPTIYHLREALMTQHRKFDVREIYLAIHHIVKYRGNFLRNDAATAYRSGTLDLQQHFETLNHLFSQADLELNLNLTTDVALLDSIKQTLVRTDISRSDRQKLIMPLLAVLTGATTAEKKRQKAVVTEFAKALVGNKTKIDVLTLTDIDATEAKDWAFSLEENQDKLPGIEDRFSEVGQQIIDEVIRLYASVNLAQLIPEGKRFSQSMVEKYKRHGEDLKLLKAYIRSQSDAKRGRAIRATYDQYIDGVKSKQVTQEAFQKALGKFVDADVDLNSWAAQIKQAIDSEQFMPKLRTKQNGAIPYQVQQNELDQIINNQKEYYPWLGEENPVIKRRGKFPYKLDELVGFRVPYYVGPLITKEMQAATANAGFAWMVRKADGPITPWNFDDKVDRVASATAFIQRMQTTDTYLIGEEVLPARSLIYQRFMVLNELNNIRVDDGQLTPRQKQRLYNQVFKKHKRVTAKNIQDNLVAAGEFPTAPRITGLADPKVFNSSLSTYHDLKQVLPEAMSDVRKQADIEKIILWSTIFEDSTIFKQKLTEISWLTAAQLKQLGQLRYRGWGQLSRKLLTGLKDDNNRSIMDGLWETNANFMQLRSQPAIENQIKSANQANLTTADLQDTINELYTSPQNKKAIREVMVVLADIKDAMHGQTPNWIFVEAARGGGVAGRRTQSRSKQIVAAYQGTAQVIVSDQVQRELKEKIKNKANFNTRLVLYFLQNGRDLYTGDAINIDRLSEYDIDHILPQSLVKDDSLDNRVLTNARINREKNDTFASEKFGKKMGAKWKEMHRMGLMTKRKLDHLLMRPDEISKYATGFINRQLVETRQVIKLVEELINAEYPSTAIVSVKANLTHQFRQTFDFPKIREVNDYHHAFDAALTAFIGTYLLKRYPKLERFFVYGKFAKQPVNLTRFNVIRKLAKTDTPITDIDTGEVLWDKLTDIKYFETLYDYKRLLVTREVSENYGAMFDQTLLKASDNGKRLIRKKQSFDTAIYGGYTGKTLAYMAIVKVSTKKDVQYQVVGVPTTMVTQIEQLEQQGMTNKQAVTKVIEPLIAANNKKMLTYEVLLPKVRFEQVVRDRIKGQTHRFALGTDTYYHNIQELYLPLTLQRAFLGKQNESEVQLNQNLLTVFDATLAQVNRYFPLYEMNKFKKILNSARDQIELLEAKNQFVKNKLVLGKQGILTNMFIGLHANASFGDLKSLGVKTSFGQLQVPGGIKLTGDAEIIYQSPTGLFERKIALKDL

SEQ ID NO: 945 - protein, 1358 aa, Artificial Sequence
  Cas9
MKQGKRGYYLGLDIGTDSIGYAVTDEQYHLLRFHGNDAWGSHVFDSASLCDERRGFRSARRRLDRRQQRVKLLQEIFAKEIANIDPRFFIRLSESYRWRDDTDDRYIYFNEEEYTDIQYMRDYPTIHHLICELMENEEEHDIRLVYLACAWLVAHRGHFLSQLSVDNIDSLIDIESVYQKFLHFFIDNGCENPWIQDAELVGGILKEHIGVTEKHNRLGEIMLGNRKPSKDVRDTFLYSEYCIIRLLAGGTCKLRDLYGKEEYEDFGSVSLEMDDDKLAEIMINIGEDYELIAVLRSLHDWSVLADILDGQNGLTNISTAKVAIYEQHKKDLATLKYFIRKYCPEKYNAIFKDAREDNYVAYSYHYNNKLDGQIKKKADTETFSKFLIKIIHSIKPDKEDEIIYQDMDNRLGLRQFLPKQRNTDNRVIPHQLYEYELKKILENAAKYLSFLNQKEDGISNTEKIISIFKFKIPYYVGPLNKHSEFAWIDRKSGKILPWNYENMIDDDASEEAFIKKMTNQCTYLPGESVLPKDSLCYQKFMVLNEINNIKVDGRKISVGAKQGIYSDLFLKYKKVKRSQIEEYLISNGQLEKNRRETLSGIDIQIKSSLSSHIAFRRLLEQKILNEADVERIIERASYAEDKGRVAKWLRAKYPHLTEADIKYICKVKIKDFGRLSRTFLTGIEGACKETGEVATIISMMWESNDNLMELLSERYTFADTILEFKSDYYTERKQTLSERLDEMYVSNAVRRPIYRTLDIVKDLEKAFGKPEKIFIEMTRGAMPELKGKRTKSRQQQLLEYYDKCKEEDVRDLKQQLEALGEYVDNKLQSDRLFLYFMQFGKCAYSGMPISLERLMAGSKEYDIDHIYPQAYVKDDSIINNKVLVLSVANGEKKDVYPIKSEIRNKMQKTWSFWHHVGTISDEKYKRLIRSTPFTEDEKYGFINRQLTETSQSTKVVAELLKERYPEAEIVYSKAGLISDFRHEFDLYKSRSYNDLHHAVDAYLNIVVGNVYHMRFSRQWFNVNSSYSIKTKTLFTHTVNCNGKEVWNKDMLPGVLKTAKKNTAHFTKHATFKTGGLFDQNPVKKAPGLTPLKAGLPTEKYGGYNKAGVMFFIPVRYKSGKKTVLMVLSVELLYGNRFLEDEIFAKEYAKDRLQRMIGKSVDEIDFPIGMRPWKVNTILSLDGFRICITGNASGGKCLIAQPIMQFSSDEYWKYYLKKVEKFVEKVKNNSSYVYDVDYDAVQHEDNLKLYDLYLDKLQNSIYRKRINAPIQTLIEGREKFIDCSVIEQCQVLLNIHQVFGRMTSGCDLTLIGGKTRSASTVNFSSIILNWKKNYTDVRIIDQSASGLWEVVSENILEYL

SEQ ID NO: 946 - protein, 1358 aa, Artificial Sequence
  Cas9
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 947 - protein, 1360 aa, Artificial Sequence
  Cas9
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKAIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQFDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLNAGMINSLANIRYRGWGQFSHKLLNELTLSTGRTVFEELLISSHNLMQILTDEVLKQKIAELNAHELKASGIYAAIDDAYTSPSNKKALRQVLSVIDDITNAAGQAPNWLYIETADGDGVPGKRTNSRQRKIQEIYVNAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 948 - protein, 1360 aa, Artificial Sequence
  Cas9
MTKLNQPYGIGLDIGSSSIGFAVVDANSHLLRLKGETAIGARLFREGESAAGRRASRTTRRRLSHNRWRLRFLQDFFDPHISSIDPDFFLRQKYSEISPKDKERFKYEKRLFNDRTDAQFYKQYPTMYHLRLHLMNDASKADPREIFFAIHHILKSRGHFLTPGDAKNFNTDDVDLKHIFPALTEAYAQAYPDLTLSFEPSKAEKFKSILLDEDATSNDTQKALVKLLLSDDGDKEVLKQQKKVLTEFAKAVAGLKVKFNVALGIEVTDADVEKWHFGMAQLEDKWSDIEPSLTDQGMEIFEQIQDLYRARLLNGIVPAGKTLSQAKVDDYDQHCKDLKLFKEYLKQLNDHDLAKRIRLLYDRYIDGDDAKPFLRDDFVKALKKEVTAHPTELAESLLERMEQDNFMLKQRTKANGSIPVQMQQRELDKIIANQAEYYSWLAAENPVKEHRDSKPYQLDELLNFRIPYYVGPMITKKQQEKSGQNVFAWMVRKDPSGNITPYNFDEKVDREASANAFIQRMKTTDTYLIGEDVLPKQSLLYQKYEVLNELNNVRVNGESLSTDQKKRLIRELFERHSSVTLKQFVENLVAHGDVAKRPDVRGLADEKRFLSSLSTYHQLRGILHDAIDDRGKQSDIENIITWSTVFEDASIFKSKLGEISWLDSKTRTTLSNIRYRGWGQFSRKLLDGLKLGNGHTIIQELMLSSRNLMQILTDETLKKEMATLNQERLKPDSINEAIDAAYTSPSNKKAIRQVLKVVDDIKHAANDQAPSWLYIETADGGGHPGKRTLSRQKQIQAIYENTAKELIDSAVRGELKDKIADKTNFSDRLVLYFMQGGHDIYTGTALNIDQLSSYDIDHILPQSLIKDDSLDNRVLVHAKINREKNAEFASTLFAAKMASTWHRWRDAGLISGRKLKNLLMRPDEVDKYAKGFVARQLVETRQIIKLTEQIVAAQYPDTKIIAVKAGLSHQLRQELDFPKNRDVNHYHHAFDAFLAARIGTYLLKRYPNLAPFFTYGEFTKTNLKKLQSFNFIGALTHTDGKITSKDTGEVLWDNQRDIEELDQIYNFKRMLITHEVYFETAGLFKQTVYAAKDSKERGGSRQLIPKKKGYSTGIYGGYTQETGSYNALVRLTKAGKVVYRVFKISTQNAAEIAAARSLSAEEGNERLCQILEQSLLKTNKDKKNTVDLFDVVIPRLGKEALFHNSKYGLFLVNSDTYYHNYQELWLSRENQKILKKLFSTKYDQSEMDRDALHLFETIAKQVEQFFKLYDINQFRTKISSAFDAFEKLPVEGEEGKVETLKQLLIGLHANPVRSDLKNLGIKTPFGFLQAGKGIHLDDDTEIIQQSPAGLFKRRVRLADL

SEQ ID NO: 949 - protein, 1361 aa, Artificial Sequence
  Cas9
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 950 - protein, 1361 aa, Artificial Sequence
  Cas9
MKKPYSIGLDIGTNSVGWSVVTDDYKVPAKKMKVLGNTDKEYIKKNLIGALLFDSGETAEATRMKRTARRRYTRRRNRILYLQDIFSPELNQVDESFLHRLDDSFLVAEDKRGERHVIFGNIADEVKYHKEFPTIYHLRKHLADSSEKADLRLVYLALAHIIKYRGHFLIDEPIDIRNMNSQNLFKEFLLAFDGIQVDCYLASKHTDISGIITAKISKSRKVEAVLEQFPDQKKNSFFGNMVSLVFGLMPNFKSNFELDEDAKLQFSRDSYDEDLENLLGIIGDEYADVFVAAKKVYDSILLSGILTTNNHSTKAPLSASMIDRYDEHNSDKKLLRDFIRTNIGKEVFKEVFYDTSKNGYAGYIDGKTNQEDFYKYLKNLLQKVDGGDYFIEKIEREDFLRKQRTFDNGSIPHQVHLDEMKAILRRQGEFYPFLKENAEKIQQILTFKIPYYVGPLARGNSRFAWASYNSNEKMTPWNFDNVIDKTSSAQAFIERMTNNDLYLPDQKVLPKHSLLYQKFAVYNELTKIKYVTETGEARLFDVFLKKEIFDGLFKKERKVTKKKILNFLDKNFDEFRITDIQGLDNETGNFNASYGTYHDLLKIIGDKEFMDSSDNVDVLEDIVLSLTLFEDREMIKQRLLKYEDIFSKKVIANLTRRHYTGWGRLSAKLINGIKDKHSRKTILDYLIDDGHSNRNFMQLINDDNLSFKDEIANSQVIGDGDDLHQVVQELAGSPAIKKGILQSLKIVDELVKVMGYNPEQIVVEMARENQTTARGRNNSQQRLGSLTKAIQDFGSDILKRYPVENNQLQNDQLYLYYLQNGKDMYTGDTLDIHNLSQYDIDHIIPQSFIKDNSLDNRVLTNSKSNRGKSDNVPSNEVVKRMKGFWLKQLDAKLISQRKFDNLTKAERGGLSAEDKAGFIKRQLVETRQITKHVARILDERFNRDFDKNDKRIRNVKIVTLKSNLVSNFRKEFGFYKVREINNFHHAHDAYLNAVVAKALLIRYPKLEPEFVYGEYPKYNSYRERKSATEKMFFYSNIMNMFKTTIKLADGRVVEKPVIEANEETGEIAWDKTKHFANVKKVLSYPQVSIVKKVEEQTGGFSKESILPKGGSDKLIARKTKNNYLSTQKYGGFDSPTVAYSIMFVADIEKGKSKRLKTVKEMIGITIMERSRFESNSVTFLEEKGYRNIRENTIIKFPKYSLFELENGRRRLLASAIELQKGNEMFLPQQFVNLLYHAQHANKEDSVIYLEKHRHELSELFHHIIGVSEKTILKPKVEMTLNEAFEKHFEFDEVSELAQSFISLLKFTAFGAPGGFKFLDADIKQSNLRYQTVTEVLSSTLIHQSVTGLYETRIDLSKLGGE

SEQ ID NO: 951 - protein, 1361 aa, Artificial Sequence
  Cas9
MGNYYLGLDIGTNSVGWAVTDENYNIERFKKKNMWGIRLFDEAKTAESRRIHRQARRMRQRKIQRLNLLMELFDVEISKVDESFFIRKKESDLHYEDKSQDSRYALFNDKEFNDKDYHNKYPTIFHLIMDLIENDEKKDIRLLYLACHYLIKNRGHFIFEGQKFDVNSSLNNNINKLKSHLDQFYNICLDFDNDKLIEILVNQNLNISEKSKKIKELLRKTNLEVGIANLIAGGSIKLSNMFDDDELKNLDYNSLSFKNSNFDEGRELFEEVLEDRFELVEILKDIHDASVLETMLSSASISPDGGKYISSSMINSYNKHKRDLKLLKKIIKKYKKSEYDNIFRDENIKNNYLSYTRTGINKNKKVQAEDNTDSDGFYKYIVKILKDIKENDSDEDIKYILSEIDKKNFVPKQRTKENSVIPYQLREIELRKIIDNQSKYHKFLNEVDEKGISVKEKIISLLTFRIPYYIGPLNPSYNEEKNFTTSWVKRLAKGKVTPWNFEDMVDIDASREAFIENKLNKCSFLLDETVLPKDSLLYQEYMVLNELNNLKINGQSINTDLKKSIYEELFKKYKKVTRKRLISYIKEKENMSGDIVITGIDGDFKQGLKSYIAFKDIIGEKIDDDIYRKEVEKIIRDISLYGDDKSFIQKKIKNENKLDLSDDQISKIAKLKFKDWGRFSKKLLVGIKASDKNTGEIDNIIGFMRNYNYNIMQLMANVFTFKDEIEKLNSKYYTDEKINIDYLDDLYLSSPAKRMLWQSFQIVDEIKNIKNSDPKKIFIEMARSKEDKPTRKMSRKSRLEKLYTDSKKQFIKLFGPDEYDKLNNEIKNKSESDFRWDNLYLYYTQFGRCMYSLDPIDLEELSNKNLYDQDHIYPKSKIYDDSIENRVLVKKQLNLDKSNEYPIPDRVLNKDKNKLLAFWKMLNEKELIGDKKYARLIRKSPFTDEELGDFIARQLVETRQATKETANMLKRLCPDSKIVYVKAKNVSDFRRKFDILKCRSINDLHHAHDAYLNIVVGNVFDTKFTSNPLNFIKNNSKNRSYNLEKIYDYDVIRNEKIAWLAERKEENQDGSIATVLKNLSKNDIRVTRRTYIKCEDLFDENIVRKGNGKFPIKENNNKSDTNKYGGYSGIKNAYFVLLEDEKHNRILEAIPSFIYKKEKNGEKGSVINYLQNILGIKSAKILRDKIKIGSLLKIDKFPYNLAGKSGNGILISGGVQLILDKNTSKYIKKIENYKYKLDENKDYQINIFDKLSKEENIKLFDLFVDKFENSIYKNRVNIKLKEIKLARPKFEHLSIEEQIKTLTQMLILFGRENNAVNLEYIGLPKNTGKTKINKKINNKDIKIINQSITGLYETEEDLANI

SEQ ID NO: 952 - protein, 1361 aa, Artificial Sequence
  Cas9
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 953 - protein, 1361 aa, Artificial Sequence
  Cas9
MKNEENIYLGLDIGTDSVGYAVTDDKYKIMKYHGNAAWGSTIFDAGALGADRRVFRSARRRLDRRQERIQLLQEIFANEIAKVDERFFIRLLESGLWRADAEDRYVFFNDKEYTDVQYMRDYPTIHHLICELIYNPNKHDVRLVYLACAWLVTHRGHFLSNINTENIADLVDIHNVYNGFMRFFEENEIICDWREVNVEELGRVLAANIGINEKYRNLSTVLFATRKPDKKAKEGFPYSEDAIVRLLAGGTCKLKDVYIKEEYDEFGSITLGMDDEKMTEIMADIGDDFDLIKALRSLYDWGILANILVNENNSPLISQSKVKVYEQHREDLANLKYLVHKYIPHKYNEIFREIRGDNYVAYSYHYELKNDEKMGKKADVEKFSKFLLKILEGISVDEQDKVVYDNMIERLTLRLFLPKQKNTDNRVIPHQLYEYELKSILKNTKNYLPFLKEKDSDGISNEDKIISIFKFKIPYFVGPLNCNSQFAWIQRKADGKIFPWNFEDKVDFDASEQAFIQRMTNQCTYLPEESVLPKQSLYYQKFMVLNEINNIKIDGRKISVAMKQELYNEIFEKKKRVRKKDVIDFFVSNGYLEGGKEALISGLDEQIHTNLSSFHAFRRLLQNHILSVEDVESIIERASYSDDKRRVLLFLKNKYSFLTDEDIKYICKIKIKDFGRLSKKFLVDFEGTCKETGEISTVLRLMWETNNNLMELLSDKYTFANGIKENRKKYYTEQQKTLDDRLDEMYISNSVKRTIYRTLSVVKDVTKAFGVPKKIFVEMARTNNPDLKGKRTRTRQQQVIELYAKCDEEDVRELKHQMESLGEYVDNKLQSDKLFLYFIQFGKSAYSGKMIDLEKLMSGSKVYDIEHIYPQAYVKDDSIINNKVLVFSEENGAKQDIYPIKTEIRKQMSGIWTTWHHVGAISDEKYKRLTRSTPFNEDEKYGFINRQLTETSQSTKAIAQILNEKYPETEIVYVKAGLVSDFRHEFGLCKCRSYNDLHHAIDAYLNVVVGNVYNMKFNRKWFSVDSKYSIKTKTIFSHSLVCNGKIIWDKEKMLPMVLKNAKKNNAHFTKYQFMKTGGFFDQMPCKKASGLVPRKKGLDTERYGGYNKSGIMFLTPMRYKIGKKSDIIILSIELLYGKLFLKDEVFAKKYAEERLQKIIGKKADEVSFPMGMKPWKINTVLSLDGFNVCITGIGGGGKCLSAQPIMQLSLPYELAKYLKKIEKFVEKNKNNANYIYDEQYDSVSVDENIKLYDVYLDKLENSIYNKRINSPEAILKNGREKFCKLNVLEQAVTLINIQSIFGRMTGGCDLENIGGKKHSAATVNFSSNVSNWKKYYNDVRVVYQSPSGIWERRSQNILELL

SEQ ID NO: 954 - protein, 1361 aa, Artificial Sequence
  Cas9
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDKEFYDDYATIYHLRDKLMTSNRKFDIREIYLAIHHIVKYRGNFLRTGPASQYGSASLHLATSFQKLNDLFAQSEETLNLKLVTDEALLQQIQQILVRTDLSRSEQQRQIWPLMAVLTGASAAEKKRQKNVVVELSKALVGLKAKMNVVTLTEVDAAVVKDWTFTMEESQDKLPEIEEQLSEVGQQIMDEVIQLYASVNLAQLIPAGKRFSQHMVEKYKHHEKNLELLKAYIHSQSDSKRGREIRATYDRYIDGVDSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDRKLAPQQKQRLYNQVFKQHQHVSVKNIQQNLMDAGEYRKTPQITGLADPKGFNSSLSTYHDFKKILLEAIADEHKRADIEKIILWSTTFEDSAIFKQKLEEVAWLTDAQRKQLSGLRYRGWGQLSHKLLTAFKDDKGRSIMDGLWETSDNFMQLRKQPAIETQIKEANQANLTDADIQDTINELYTSPQNKKAIREVMLVLDDIKNAMHGQTPSWIFVEAARGGGVAGRRTQSRSSQIVEAYKGTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPAASIVAVKANLTHQFRQTFNFPKLREVNDYHHAFDASLTAFIGMYLLKQYPKLERFFVYGKFAKQPINLTRFNIIRKLAVAEKPIANIETGEILWDKTADIKYFEKLYNYKRLLVTHEVRENYGAMFKQTLFKASYNKSKTLVPKKNHMETSVYGGYSNQETAYLAIVRIPFKSGFKFIVVGIPTRMVAKIKHYQSLGATLNQATHKVIEPKFTKISRKTKQTVISDYEVVLPKVYLDQVVRDQVKGQMYRFSLGSDKEYHNVQELYLPLSIQQAFVGHYDESDDQRSNDLVKVYDAALKQLQRYFPLHLSRNFDQVASQAHQSFEGLKNNVQTSDKQLGKKEVLNSLFVGLHANATRSNLSVLGMSKDFGRIKSNGITLTDQAEIIYQSPTGLFERKVALKDL

SEQ ID NO: 955 - protein, 1361 aa, Artificial Sequence
  Cas9
MGNYYLGLDIGTNSVGWAVTDENYNIERFKKKNMWGIRLFDEAKTAESRRIHRQARRMRQRKIQRLNLLMELFDVEISKVDESFFIRKKESDLHYEDKSQDSRYALFNDKEFNDKDYHNKYPTIFHLIMDLIENDEKKDIRLLYLACHYLIKNRGHFIFEGQKFDVNSSLNNNINKLKSHLDQFYNICLDFDNDKLIEILVNQNLNISEKSKKIKELLRKTNLEVGIANLIAGGSIKLSNMFDDDELKNFDYNSLSFKNSNFDEGRELFEEVLEDRFELVEILKDIHDASVLETMLSSASISPDGGKYISSSMINSYNKHKRDLKLLKKIIKKYKKSEYDNIFRDENIKNNYLSYTRTGINKNKKVQAKDNTDSDGFYKYIVKILKDIKENDSDEDIKYILSEIDKKNFVPKQRTKENSVIPYQLREIELRKIIDNQSKYHKFLNEVDEKGISVKEKIIALLTFRIPYYIGPLNPSYNEEKNFTTSWVKRLAKGKVTPWNFEDMVDIDASREAFIENKLNKCSFLLDETVLPKDSLLYQEYMVLNELNNLKINGQSINTDLKKSIYEELFKKYKKVTRKRLISYIKEKENTSGDIVITGIDGDFKQGLKSYIAFKEIIGEKIDNDIYRKEVEKIIRDISLYGDDKSFIQKKIKNENKLDLSDNQISKIAKLKFKDWGRFSKKLLVGIKASDKNTGEIDNIIGFMRNYNYNIMQLMANVFTFKDEIEKLNSKYYTYEKINVDYLDDLYLSAPAKRMLWQSFQIVDEIKNIKNSAPKKIFIEMARSKEDKPTRKMSRKSRLEKLYTDSKKQFIKLFGPDEYDKLNNEIKNKSESDFRWDNLYLYYTQFGRCMYSLDPIDLEELSNKNLYDQDHIYPKSKIYDDSIENRVLVKKQLNLDKSNEYPIPDRVLNKDKNKLLAFWKMLNEKELIGDKKYARLIRKSPFTDEELGDFIARQLVETRQATKETANMLRRLCPDSKIVYVKAKNVSDFRRKFDILKCRSINDLHHAHDAYLNIVVGNVFDTKFTSNPLNFIKNNSKNRSYNLEKIYDYDVIRNEKIAWLAERKEENQDGSIATVLKNLSKNDIRVTRRTYIKCEDLFDENIVRKGNGKFPLKENNNKSDTNKYGGYSGIKNAYFVLLEDEKHNRIIEAIPSFIYKKEKNGEKGSVINYLQNILGIKSAKILRDKIKIGSLLKIDKFPYNLAGKSGNGILISGGVQLILDKNTSKYIKKIENYKYKLDENKDYQINIFDKLSKEENIKLFDLFVDKFENSIYKNRVNIKLKEIKLARSKFEHLSIEEQIKTLTQMLILFGRENNAVNLEYIGLPKNTGKTKINKKINNKDIKIINQSITGLYETEEDLANI

SEQ ID NO: 956 - protein, 1362 aa, Artificial Sequence
  Cas9
MKKPYSIGLDIGTNSVGWAVITEDYKVPAKKMKVLGNTSRDFIKKNLLGALLFDSGETAEARRLKRTARRRYTRRRNRLRYLQEIFLDEMNKLDSGFFHRLDDSFLVPEEKRGSRYPIFGTLQEEVNYHENFPTIYHLRKKLADSKEKADLRLIYLALAHMIKYRGHFLYEESFDSNNNSIQEIFNEFTAEYHNTIEGSCLSGQIEQVEAILTDKISKSAKRERILKLFPAEKSTGLFSEFLKLIVGNQADFKKHFDLEEKTPLQFSKDTYEEDLENLLEQIGDEFADLFLLAKKLYDATLLAGILTATDVSTKAPLSASMINRYETHQQDLAALKQFIKNKLPEKYSEVFSDLSKDGYAGYINGKTTQEAFYKYIKNLLIKFEGAVDFLEKIEREDFLRKQRTFDNGSIPHQLHLQEMNAILRRQGDHYPFLKENREKIEKILTFRIPYYVGPLARGNRDFAWLTRNSDQAIRPWNFEEVVDKTSSAEDFINKMTNYDLYLPEEKVLPKHSILYETFAVYNELTKVKFIAEGLRDYQFLDSGQKKQIINLLFKDKRKVTEKDIIHYLHTVDGYDGIELKGIDKQFNASLSTYHDLLKIIKDKDFMDDADNEAILENIVHTLTIFEDQEMIKQSLAQYDAIFDRKVMKALTRRHYTGWGELSAKLINGIRDKQTGKMILEYLKDDGEINRNFMQLINDDSLSFKETIQKAQVIGETENIKQIVQELPGSPAIKKGILQSIKIVDELVEIMGYNPESIVVEMARENQFTNQGRRNSQQRLKKLTDSINKLGSSILEEHPVDNSQLQNDRLFLYYLQNGKDMYTGEALELSKLSSYDVDHIIPQAFIKDDSLDNRVLVSYAKNRGKSDDVPSLEIVQKRKAFWRQLLDSQLISERKFNNLTKAERGGLTEDDKAGFIKRQLVETRQITKHVAQILDARFNTEVTEKGKKKRAVKIITLKSNLVSNFRKDFELYKVREINDYHHAHDAYLNAVVGTALLKKYPKLEPEFVYGDYPKYNSYRERKTATEKVYFYSNIMNFFKTTVKLADGSEKKRHQIETNEETGEIVWDKTKHFEIVRKVLSYPQVNIVKKTEEQTVGQNGGLFDNNIVSKNKVVDASKLIPIKSGLSPEKYGGYARPTIAYSVLVIADIEKGKAKKLKRIKEMVGITIQDKKKFEANPIAYLEECGFKNINSNHIIKLPKYSLFEFDDGQRRLLASSIELQKGNELILPYHLTALLYHAQRINKISEPIHKQYVEAHQNEFEELLTTIISLSKKYIQKPNVESLLQQAFDQTDEDIYQLSESFISLLKLISFGAPGAFKFLGVDISQSNVRYQSVSSCFNATLIHQSITGLYETRIDLSKLGED

SEQ ID NO: 957 - protein, 1362 aa, Artificial Sequence
  Cas9
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDKEFYDDYATIYHLRDKLMTSNRKFDIREIYLAIHHIVKYRGNFLRTGPASQYGSASLHLATSFQKLNDLFAQSEETLNLKLVTDEALLQQIQQILVRTDLSRSEQQRQIWPLMAVLTGASAAEKKRQKNVVVELSKALVGLKAKMNVVTLTEVDAAVVKDWTFTMEESQDKLPEIEEQLSEVGQQIMDEVIQLYASVNLAQLIPAGKRFSQHMVEKYKHHEKNLELLKTYIHSQSDSKRGREIRATYDRYIDGVDSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDRKLAPQQKQRLYNQVFKQHQHVSVKNIQQNLMDAGEYREAPKITGLADPKGFNSSLSTYHDFKKILPEAIADEHKRADIEKIILWSTTFEDSAIFKQKLEEVAWLTDAQRKQLSGLRYRGWGQLSHKLLIAFKDDNGRSIMDGLWETSDNFMQLRKQPAIETQIKEANQANLTDADIQDTINELYTSPQNKKAIREVMLVLDDIKNAMHGQTPSWIFVEAARGGGVAGRRTQSRSSQIVEAYKGTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPAASIVAVKANLTHQFRQTFNFPKLREVNDYHHAFDASLTAFIGMYLLKQYPKLERFFVYGKFAKQPINLTRFNIIRKLAVAEKPIANIETGEILWDKTADIKYFEKLYNYKRLLVTHEVRENYGAMFKQTLFKASDNKSKTLVPKKNHMETSVYGGYSNQETAYLAIVRIPFKSGFKFIVVGIPTRMVAKIKHYQSLGATLKQATHKVIEPKFTKISRKTKQTVISDYEVVLPKVYLDQVVRDQVKGQMYRFSLGSDKEYHNVQELYLPLSIQQAFVGHYDESDDQRSNDLVKVYDAALKQLQRYFPLHLSRNFDQVANQAHQSFEGLKNNVQKSDKQLGKKEVLNSLFVGLHATATRSNLSVLGMSKDFGRLQSRSGITLTDQAEIIYQSPTGLFERKVALKDL

SEQ ID NO: 958 - protein, 1362 aa, Artificial Sequence
  Cas9
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKGYPVDIYGGYFRENTAYLAVVKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 959 - protein, 1362 aa, Artificial Sequence
  Cas9
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKENEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKGYPVDIYGGYFRENTAYLAVVKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 960 - protein, 1362 aa, Artificial Sequence
  Cas9
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKSRYKYEKRLFNDRTDAEFYKYENCPTMYHLRNRLMTDPSKADVREIYFAIHHILKSRGHFLTPGDAKDFNTNKVAVNKIFPALQDAYAQVYPDLDITFDENKVNEFKTVLLNEKATPSDTQRALVNLLLAKEGDRDILKQQKQALTEFAKAVVGLKTKLNVALGTEVDSSEATAWNFSLGQLDDKWTGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIENIIAWSTIFEDKAIFKTKLNEISWLNAGMINSLANIRYRGWGQFSHKLLNELTLSTGRTVFEELLISSHNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGKPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 961 - protein, 1362 aa, Artificial Sequence
  Cas9
MNQEPYAIGLDIGTSSLGWANADMDGYIARVKGQTGLGVRLFEEGQPAADRRSFRTTRRRLSRRRWRLRLLREIFDEPISSIDPNFFARQKASSISPKDDRFETTYQLFNDKTDQEFYSKYPTIYHLRWALMTEHRKFDLREIYLAVHHIVKYRGNFLRSGNPKSFKPSELDFSQRFKEVNGLWHLIFDEVAPQLPTDNLEEITKLVLDTTRTRADRQRESVKLLMAATDNHKDWKPYLTEFTKAILGLKTKLYLLTGVDVAKADQKTWTFSLEDIEDHRADLETAFDDRSLELIEKLVDLQAAIQLTEIMPSGQYFSQSMIYRYDQHKEHLRWLKDYAEQQTDANKRKAVRLAYDHYIEGDAKGKPEIADDFYKELNRILKGDTSELAKKINHEIALEHFMPKQRTKENGVIPYQIHQQELDSIIDNQKKYYQFLGEDNPVVSHHGSQPYKIDELVSFRVPYYVGPMITADQQKKTAAGQFAWMVRKDSGDITPWNFDDKVDRTASATNFIQRMKTTDTYLIGEDVLPLQSLTYQKFMVLNELNNIRINGELLTREQKQRTYNDVFKGHGTVNVKSLIKSLECHSEVTGAIKVEGLADPKRFNSALTTYRDFKKILPVAIDQPQRQADIERIINWSTIFEDADIFKAKLQEIDWLTDTQRDRLSTKRYRGWGRLSAKLLLNIKDTQGLSIMDQLWNTQHNFMQIVHEPDYAEKIEKTNAKGLKQQDIFETINEMYTSPQNKKALRQILAVVRDIQKAHHGQAPSRIFIEAARGAEQNPQRTRQRQKQLADLFADQAKEIVNETVAQELNDETDNKARFTDRLMLYFLQNGQDMYTGEKLNIDKLSTYDIDHILPQSLVKDDSLDNRVLVSKVENLKKNDHFASELYARKMQGTWELWRSAGLISARKLKHLLMRPDEINKYATGFIRRQLVETRQVIKLVTDVLSNEYDSDKTKIISVKAGLSHQLRMELDLPKVRELNDYHHAFDAFLAVRIGTYLLKRYPKLERFFVYGQYQVAPQLDLRRFNFIHDLVSGKQEKIVAEETGEIVWNREKDVSYMKHLLSLKHLLVTHEVKEDHGALFNQTIYKAKKDNGNVGGKMKLLPTKSNRPTEIYGGHSSQAIAYLAIVRVNGKEPSYRVMGVPIRILDQLKQAKKQGEYAERLALKQFFTPDFTKGKGKIVSDFDVVIPHIPLLQPVIDEISGQSHRFALGTNTYYRNLQQLILTLADQKVLISKETGVDEEKKLVEVYSHICQQVMKFFPLYDRNKFRELLVDSRSHFEQLPIVNRYSDAGKLEIAGKRGILQQIMVGLHANATPGDLKELGVKTPFGKLQVPGGIKLTENAKLIYESPTGLFKREVKITTE

SEQ ID NO: 962 - protein, 1362 aa, Artificial Sequence
  Cas9
MKKKAEKIYLGLNVGTNSIGYAVTDEQYRLLKFNGNDAWGSIVFDAASSNEDRRNHRLARRNLDRRQQRIVWLQEIFAKEISKVDDRFFIRLSESFRWREDVQDRYVFFNDKEYTDVQYMKEYPTIHHLICELMDNKTPHDVRLVYLACAWLITHRGHFLNNLNVEKLDEIMDFSSVYQNFINYFTENGYKRPWGEIDVSALSEVLKQKTGITVKNKELQNILLEGKKPEKSGTEEFPFSQDSIIRLLAGGQCKLKDVFCKEEYLDLGSVSLGMDEEKFDEISGSIGEDYDLLIALRGLYDWSVLANLLNGHSETISMAKVQMYEQHGKDLQILKYFVRKYVPDKYNEVFRKAKADNYVAYTGHMDKDTASQIKKKAKAEEFSKYVLKLMSPIKPEKTDLQSYEDMCERLKLNRFLPKQKNTDNRVIPHQLYEYELIQILKNASVYLPFLNDTNNGISEADKVLSVFRYKIPYYVGPLNEESSFAWISRKQGKITPWNFKEMVDEDASENAFIRRMTNKCTYLPTEDVLPKDSLCYQKFMVLNEINNLQIDGLKIPVKAKQGIYHELFEKNKKVKRKDIEEYLIRNNYLDKDSTELISGIDEQIHSGLSSYCAFFNLLNKKILSEDDVERIIERASYAEDKSRVIKWLRKEYPGLSEDDIRYIARIKIRDFGRLSKTFLTGLKGCDVSKGFDGQDVEMISILQTMWETNDNLMEILSDKYTFLEALEAFTQEYYTGKKKSLKERLDEMRVSNSVRRPVYRTLAVVKDIEKAFGKPNKIFVEMTRGGQADQKGKRIKSRKQQILDLYDKCKDDVHDLMWQLESLGEYADSRLQSDRLYLYFMQFGKCAYSGAHIGFEQLMAGSVEYDIDHIYPQSYVKDDSLNNKVLVLSDLNGTKDNIYPVSPEIRGKMQGLWSWWNHVGAISDEKYKRLIRSAPFTDEEKMGFINRQLTETSQSTKFIADLLKERFPDAEVVYVKAGLVSDFRHEFDLPKSRSYNDLHNAADAFLSVVAGNVYDMRFSKKWFRIDEKYSVKVKTIFTHEVKCRGDIIWDGMPMLEKVEDTARKNTAHFVKYAAFKTGGLFDQNPVKKGTGLIPLKAGLPTEKYGGYNKAGIMFLIPVRYNIGKKSEILILPVELMHGKHFLEDKVFARNYTFTRLENILGKKVGEVSFPMGMRPWKINTMLSFDGFRVCLTGTSGRGKCLVAQPVMQFSADEHWRFYVKRLERFVEKIGINPDLLYDKDHDKVSKDENLKLYELYVDKLQNTIYKKRVNSPVQTLLKGKEEFKKLSIEEQCQVLLNIQSVFGRMTGGCDLTLIGGSAHSAATGSLSTTISNWKKKYSTVRIIDQSPSGMWEKSSENLLDFL

SEQ ID NO: 963 - protein, 1363 aa, Artificial Sequence
  Cas9
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKMKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKVIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLTAGMINSLANIRYRGWGQFSHKLLNELTLSTGRTVFEELLISSHNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 964 - protein, 1363 aa, Artificial Sequence
  Cas9
MRGNYHIGLDIGTSSIGWAVIDDNAKVMRAKGKTAIGARLYNEGQTAADRRLFRTTRRRLNRRKWRLKLLDEIFDPYITPVDAAFFARLKQSNLSPKDQNRDWTGSMLFPDRTDRKFHKDYPTIYHLRHKLMTEDHQFDIREIYLAIHHIVKYRGNFLNTTPVSSFSVSDVKFDEQFDRLNELYAAVSPDEPFAINGDNSKAIETLLLSDETKKFDKQKQSAKLILSETGDKALDKENTKVATQISKAILGYKTQLDVLLKYDAINSSAWKIELDDENIDDTLPGLLSQLDENRQEMVSIIQNLYAQVTLNQIVPNGMSLSESMIEKYNAHRDHLKLLKQLEDKIDDPKKKKGLEAAYDAYVGKNMKVANQDVFYASVKKNLDDSDLAKQIADLIEAQKFMPKQRTSQNGVIPHQLHQLELDQIIENQSKYYPWLTAANPNPKRIHQAKYKLDELVAFRIPYYVGPLVTPEEQEKSANQVFAWMKRKQPGTITPWNFDQKVDRMASANRFIRRMTTKDTYLIGEDVLPDASLIYERFKVLNELNLVKANYHRLAPAQKQAAYRDLFENQKSISTKKLQNYLVDQGYFTAKPKITGLSDPERFNSSLGTYIDFKEIFGDQVDNPDRQDDYEKIIEWSTVFEDRQIYEAKLRTLDWLTEDQIQALKTKRYNGWGRLSKKLLTGIVDENGERIIDVLWNTNQNFMQVQSQESFAKRIHEANAKQMKVTGVEDILADAYTSPQNKKAIRQVIRVVDDIQKAMGGVAPTSVSIEFTRSEDQNPRRTQSRESQLQNTFKVDAKEIVDSDLVTELETVSKSKKGLTDRLYLYFTQLGKDMYTGDPLNIDELSTYDIDHILPQAFIKDDSLDNRVLVSKAVNNGKSNNVPVKLFGGKMGGFWKELADHRLISKRKLKHLLTDPDTIDKYTMRGFIRRQLVETSQVIKLVAQILGDKYQNDDTKIIEVTAKMNHQMRENFKLIKNREVNDYHHAVDAYLTAFVGQYLYKRYPKLRPYFVYGNFKKFNEDHVSFRYFNFLHELMDENNKRIVEPETGEVVLEREPAIAYMKRVYHFKFMLISQEVYTRRDAMFNQTIYPAKEANRRKLIAIKHGKPVDVYGGYSGSVDAYMAIVRIHDKKGDKYKVVGVPMRALEILNATHDKKDYDAKLKQILVPKFTKVKKSRKTGEITKKVEDFEIVLGKVMYRQLVIDGDKKFMVGSSTYLYNARQLVLSDSSLDTLASKGTLDSDADSKRLVAVYDEIVEKVDKYFPLYDKNAFRSGLHKGRDKYLLLPNRSTFNGAKKVHSGKREILNEILNGLHANATLGGLKDLKISTPFGKMQGQSGIPLSSNTIICYQSPTGLFEHRVSLKDL

SEQ ID NO: 965 - protein, 1363 aa, Artificial Sequence
  Cas9
MENNRYNVGLDIGTSSIGFAVTDEQDELVQVKGKNYIGVRLFKEGQTASERRSFRTTRRRLKRRKWRLGLLEEIFAPYLAQGDPYFLARMKESNISPRDERKKYYGSLLFSDDTVFYDKYPTVYHLRHALMTEDRKFDIREIYLAVHHIIKYRGNFLINTLINEFSSKAVDFKKDADILNDLFEQFYISDINDSFQLNTADMNEISELLLDNSKTRLDRQRESLKKLAKKVDDISVAKKHQKIATEFSKAILGNKAKFDVILNVTTDSSNDWSFKLEDEDADEKIVVLLEELNTPQQEALNIIHQWYSQISLNGIVPDGKSISEAMISSYELHKEHLALLKQQINNTKDKKKAHGLHEAYNEYVHGNNNKKLNQADFYSKVKQNLESSLITDEILELINAENFMPKQRTSANGVIPHQLHQQELDRIIQNQAKYYPFLAETNPNEKRSKVAKYKLDELVAFRVPYYVGPLITATDQKKTSGKEFAWMVRKQPGRITPWNFDEKVNKMESANTFIRRMTTKDSYLIAEDVLPDESLLYQKFKVLNELNNLRADGRKLKVSVKQKVFKELFQQQKTITIVKLQNYLKAECSFLTTPEISGLSKPEHFVSSLATYIDLKKIFGEDIDNPARQNDFERMIEWATIFEDKNIYSEKLNEIKWLNDRQKKELKNKNYHGWGKLSAKLLKGLRDSDECSIIEHMWNTQQNFMQVQAEEDFAQRIQEENNQHLKGNTLEEVLADAYTSPQNKKAIRQVVKVIEDIQKAMGGIAPQKISIEFTRAPEEKPRRSVERQQQIEKIYKSVANEVENAGVKDELQRFSDRKQTLTDKYFLYFTQLGKDMYTGKSINIDQIGNYQIDHILPQAFIKDDSLDNRVLVSAAVNNGKSDNVPTKNDRYKVREHGQRLYDQGLISKRKFNNLITDPDSINKFTARGFVKRQLVETSQVIRLVAEFLYNKYQSKSEIIEVRAKMNSQLRKDFGLIKNRNVNDYHHALDAYLTTFIGNYLYRRYPKLRAYFTYGCFKKVDDSQLKYFNFLHDIEDDKKKIIKDNDTGEILWHRDEGIARFKRIYNFKYMLVTHEVLTRQGAMFKQTVYSAAVAGSKKLIPVKEDRPIDIYGGYTNNNDAFLAIVKVTKKKQYMVVGIPQRAVVKLNDAAKQGSKAYQKVLYNVIKPQFIKKKKDRKTGKITQKLENFEIVVSKTLYRQLIIDGDQKYMLGSSAYKYNAKQLVLSEYALEVLDRSIFEKKEYTTVDLDNVYDEILAQVDKYFSLYDKNKFRQKLHESRKIFTELPINNLFSGTKLLKSGKRETLNEILEGLHANATKKDLKSLKFSTPLGMIQYPSGIILSENAILCYQSPTGIFERRVTLKDL

SEQ ID NO: 966 - protein, 1363 aa, Artificial Sequence
  Cas9
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKSRYKYEKRLFNDRTDAEFYKYENCPTMYHLRNRLMTDPSKADVREIYFAIHHILKSRGHFLTPGDAKDFNTNKVAVNKIFPALQDAYAQVYPDLDITFDENKVNEFKTVLLNEKATPSDTQRALVNLLLAKEGDRDILKQQKQALTEFAKAVVGLKTKLNVALGTEVDSSEATAWNFSLGQLDDKWTGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHMPEIRGLADEKRFLSSLSTYRQLKSLLPEAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDVYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 967 - protein, 1363 aa, Artificial Sequence
  Cas9
MTKLNQPYGIGLDIGSNSIGFAVVDANSHLLRLKGETAIGARLFREGQSAADRRESRTTRRRLSRTRWRLSFLRDFFAPHITKIDPDFFLRQKYSEISPKDKDRFKYEKRLFNDRTDAEFYEAYPSMYHLRLRLMTDASQADPREIFLAIHHILKSRGHFLTPGAAKDFNTDEVDLKHIFPALAEAYAQVYPDLELNFDSALADDFKAKLLDEDAKPSDIQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYIKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKQQAESGENVFAWMVRKNPSGNITPYNFDEKVDREASANTFIQRMKTTDTYLIDEDVLPKQSLLYQKYEVLNELNNVRINNEALSTDQKQRLIREVFERHSSVTIKQVADNLVAHGDFAQRPEIRGLADEKRFLSSLSTYHQLKEILHGAIDDPTKLHDIENIITWSTVFEDAAIFKTKLAEIDWLDPATIKKLSNIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLTPFFTYGEFAKVDVKKFREFNFIGALTHAKKNIIAKDTGEIVWDKERDIQELDRIYNFKRMLITHEVHFDMADLFDQTIYAAKDSKERGGSKNLIQKKQGYLTGIYGGYSTERGSYVSIIRTFKKGAPIYNIVNISTADVSLLSDKQRVSEASADVLLKELIKKKLAKRKSGENTKSGAFEIVLPRVGKNTLFKNKKYGLFLVESTTEFHNYQELWLPRNDQMLIKSIQSHKIEESKADYELTRMYRNIASQVDHYFGLYTIRKFSEKLTASINDYGALPVYKSETTDGKYEVLSNLFEGLGSGTSTGNLTAVKLQPNFGRVYLTSGIVLEDDTSIIYQSPTGLFERSVKLADL

SEQ ID NO: 968 - protein, 1363 aa, Artificial Sequence
  Cas9
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 969 - protein, 1364 aa, Artificial Sequence
  Cas9
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEKDRKFDFREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNGENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTGNFMQIQSRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLQPYFVYDNFKKFGNKEDIGHKRFNFLGKIEREKKVVAPETGEILWSNVAPNETIKQIKKVYDYKFMIVSREITTRRAELFNQTVYPKNYHGKLIPIKEDRPTDLYGGYSGNTDAYLAIVALEDKKKGKYFKVVGIPTRVAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 970 - protein, 1364 aa, Artificial Sequence
  Cas9
MEKQEYYLGLDMGISSVGWAVTNDKYELLRKKGKDMWGIREFEEADSSAERRTHRVNRRRRQRQVARMGLLKEYFSDAIEKVDSNFFIRIENSKYFFEDKDGRLSSKNGIFDDADYKDVDYYTEYPTIFHLRKALLDIEDTGKEYDVRLVYLALVNMFKHRGHFLLNTEGDALSSEQVNTTYQELLEILENNYDISLESRDIKDVIDIISSSDNGRKKKHEQILELFGVKKSDKRANELLKCLCGLSVNAKLIFDENYEEKVDLCFHDFSYTDKIPDLMEKLSEEEYYVVEQLKSIYDYSILAGTLKGYDYLSCARVELYEKHREDLKLLKALYRRYKTNEEYNDMFKSDKEGTYSAYVNSFNSSDSSVKIKKYRWNMKGRTIDNLYGTIKKAFKDNTDDKDVQSMMESIDKEQFLPKQLTGANGVIPNQVHKKEMERILKKAQNYLPFLKEKDESELTVSERILRLFTFQIPYYVGPLGENSKTGWVVRREGGRVLPWNIDEKIDMSATSEAFIGNLIRKCTYLSDEKVMPKASLSYERYCVLNEINNICIDGERLDTELKQKIYTECFMKGKRVTRKQICNYLVAQGCIKSDEQVTGIDINVNSSLSSYGKMFAIFGEHLKEDAIRKVAEEIIYWGTIFSDSKKMFRKHLTKYVEQGILGESQVKRILGYKFKDWGRFSKALLTLQGIDKSTGELLSLENAMWEYSLNFMELINSDDFTFKDELANRRTSAIKSLSEFTYEDLEDTYFSVPVKRMIWQTILVVREIEQIMGYAPKKVFVEMARSEEEKGDKGRKDSRGTQLLELYKNIKNTENHDWKKEISEANESGKLRSKKLYLYYTQMGRDMYTGEEINIDMLYDDSMYDIDHIYPRHYVKDDSIVNNLVLVNRRANQDIKKDLYPIPDKIISNPKVQELWKMLHKQNLITDEKYKRLMSRSPFTEKQLGDFIARQLVETRQGTKGIAELLGQLFKDTEIVYAKATNVSDFRRDNGFVKSRLVNDFHHAQDAYLNIVVGNVYYTKFTKNPWNFIKKDFDKDRNKNGYNLAKMFDRDVVRGDDTAWIASKKDTQGTIETVRKMMRKNTPLMTRMSFEQHGGIANATLYSAKKAKVENYIPLKSSDIRLSDVKKYGGFTSATVAYYFIVHHKEGKKENTTIEALPLYCKRKVENEENGLLKYCEEVLGYGDVKILFNKLKIQSLLDINGYQAHLSGKTGNQLTLRNAMNLCVPEKWTAYIKKLEKLVVGHVKEQEISSEANIELYDLLTDKHLNSVYAKRPNAYGQKLIDNRSRFVNLKPESQCEAILQILKLTKIGNNETNLKLIGESEHSGKMLISKNLKDTDKPAIICQSVTGLYERKIYIFDEQLDK

SEQ ID NO: 971 - protein, 1364 aa, Artificial Sequence
  Cas9
MNKRYNIGLDIGTNSIGWSVVNDQSQLVRIKGKLGYGVRLYDEGQTAEDRRLFRTTRRRLKRRKWRLGLLREIFEPYITPQDATFFLRQKQSNLSPKDLQKQQPQIGLFNDRLDSDFHYQYPTIYHLRYALMTEKRQFDLREIYLAMHHIVKYRGHFLNAAAASSFKSGEIDLAKDFAALNQIFGTIFSEVGFSLSESNLDEIKSILLDNNLSASVRQRKALPLIYQTAASKDSEKQYKAIATELLKAILGLKAKFNLITGIEVEDVKAWTLSFNAEDFDAKLSDLNIADNDDAVQIIEILRALYSGVLLTGIVPEGQSISQAMIDKYEAHKAHLIMLRSIREQLSDKENKALEKAYDDYIDHPEDKQHGSREDFYAAITKVLKKDSEDTNIIEILKLIELDQFMPKQRTKDNGAIPHQLHQQELDQIIENQKQYYPWLADINPNEQRQKMAPYKLDELVTFRVPYYVGPMITAEEQFQTSNKKFAWMIRKEPGAITPWNFDQKVDRQASANEFIKRMTTTDTYLLAEDVLPKQSLLYQRFEVLNELNGIKIDDQPITVEQKQAIFNDKFMQQAHVTVKNIQAYLVSEGQYASRPNITGLSDGEKFNSSLSTYHDLKKIFGDMIDDPNKQTDFEKMIEWSTIFEDGKIFADKLREINWLTDEQRQRLSNKRYRGWGQLSTKLLTKIVDQNGQRIIDILWNTNDNFMRIIHSDDFDQAVTQANQMLLADNDTQDVINELYTSPSNKKALRQILLVVADIQKAMKGQAPARILIEFAREKQANPRLSTQRRRQVEQVYQELNNDQLNKELADPQYANLSKDRLFLYFMQGGRDMYTGESLNIDRLSEYDIDHILPQAFIKDNSLDNRVLVSAKMNRSKSDHVPLDFTEERFGQKMRSQWEQMLRAGLLTRRKYNNLTLNPDSLNKYTMSGFINRQLVETRQVIKLATNLLVDQYADEDVQLVTVKSGLTHQMREDFDFPKNRNLNNYHHAFDAYLTAFVGLYLLKKYPKLAHYFVYGQYQQGFKANDQWRNFNFLNGLRQEQQVDAETGELIWQKDHDLAYMNKIYDFKKILVTREVHTNHGALYNQTLYKAKDDKASGQGGRQLIAAKENRPTAIYGGYSGKTVAYMCLVRITEKKGDFYRICGVQTAWVDELEHIEDATIKLQRLTALLTPQFSATKKQKDEVVTVVKPFEVLLPKILINQRFYDGGQELTLASATYKNNAQELVLDKKAVQVLNGQLPKAELEAQATVVYDQILERVQKYFPLYDMNSFREKLFVGRDKFNELPWQDQWENHKLIQVGQKTILDRILIGLHANAAMGDLKALNMSTPFGKLQKSNGISLSPETQIIYQSPTGLFERRVALKDL

SEQ ID NO: 972 - protein, 1364 aa, Artificial Sequence
  Cas9
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 973 - protein, 1365 aa, Artificial Sequence
  Cas9
MYKKDYTVGLDIGSTSVGFAAIDDDYQPIRLKGKRVIGVRLFEEGKTAAERRNFRTTRRRLNRRKWRLSLLEEIFDPYMAKVDPTFFARLKQSNLFPKDKNKKFTGSLLFPKTTDSKFYDEYPTIYHLRYHLMNDSRKFDLREIFLAIHHIVKYRGNFLNSAPIASFSTDKINLVDDFETVNAAYLQINSSNPVQLDTDQADQVSRILLDNKLSNLDKQKQAAKALAQKSGDKKQDKINNTTIKQICKALLGYKFDLAVVLNIDSDDHNKWKLQLSDENIDSRLAELTGELNEAQLDILNVLSRLYSQITLNDIVPSGMTLSEAMIEKYKAHKKHLKMLKDFARSLSKKDYGQVMEAYAEYIGNIPESASSKAQKKISQDDFYKKIKRYLDDSKLGQKIAELIAKNEFMPKQRTNQNGVIPYQLHLKELNQIIENQSKYYPWLAELNPNEKRRGKAKYKLSELVAFRIPYYVGPLITQEEQQKTSNANFAWMIRKSEGRITPWNFDEKVDRIATANRFIKRMTTKDTYLIGEDVLPAHSLLYERFKVLNELNMIRVNNHRLSVGQKQDVFEKLFQKHKTVKTRELIKQLMASGLPTQPRITGLSDPAKFNTSLGTYNNFAKILGDEINQPDRQEDFEKIIEWITIFDDKDILKTKLSELSWLDEKQINALINKNYSGWGRLSRKLLTELTNKKGQSIIDRMWNTQKSFIEIINEPVFAEQIKDANQDQLDEDDYETVLHDAYTSPQNKKAIRQVIKVVDDIVRAAGRAPKFISLEFAREDQESRRTQSRLSRIKKIYETTTKELVANDQIREELGNVKDLNDRLFLYFTQLGRDAYTGERINIDDISTKYDIDHIFPRAFIKDDSLDNKVLVKRAVNNGKSNNVPLKLFGAKMKPIWKMWKDHQLISKRKYEHLMTNPDAIDKYKANGFINRQLIETRQIIKLAANILANRYSTEDTKIIEVKANLNHQLRQSLHLYKNRQVNDYHHAVDGYLSAFVGQYLYHRYPSLQSYFVYGQYQRFFDKQVQENMKFNRFNFLYDLTDRDNDQIVVKSTGEIVGEKSKLIEQIKWVYRYKFMLVSQEVFTKTGPLFDQTIYPAGSNKSRLIPIKKDRPTDIYGGYSSSTDAYMSLIRVPDKKEDKYKVVGVPSRSLASLNRAEKRGHDAYLDQLRQVIAKSQKKEFQIIIPKLRYRQLIIDGGLKYTLGSSAYQYNARQLVLSEKSMEVLVTDFSKVTTDLDKQNQKLIAVYDDILDKVNRCLPLYDKNQFRKALNGARDKFVQLPILPKFNGNKKEEAGKVEILNEILLGLHDDASTGNLKPLGIKTPFGMLQTQSGITMSSNAVIVNQSPTGLFEHRIYLKALLNKLNK

SEQ ID NO: 974 - protein, 1365 aa, Artificial Sequence
  Cas9
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVKLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKQQAESGENVFAWMVRKNPSGNITPYNFDEKVDREASANTFIQRMKTTDTYLIDEDVLPKQSLLYQKYEVLNELNNVRINNEALSTDQKQRLIHEVFERHSSVTIKQVVDNLVAHGDFAQRPEIRGLADEKRFLSSLSTYHQLKEILHGAIDDSTKLHDIENIITWSTVFEDAAIFKTKLAEIDWLDPATIKKLSNIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLYIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDETDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIQELDRIYNFKRMLITHEVHFETADLFDQTIYAAKDSKERGGRMSLIPKKLGYLTGIYGGYQTERGSYVSIIRTFKKGETIYKVVNILTADVSLLSEKEKVSKTLADIYLKELIAKKLSKGKSGKNIASEPFEIVLPRVGKDSLFKNKKYGLFLIESATELHNYQELWLPRNDQLLIKRIQARQIEESKADYELTRMYRNIAWQVDHYFRLYKIRKFAEKLQASVEDFAGLPVYKNETSDGKVEVLASVLKRLNGAADKGRTNPTTVKLQSDFGRTLLTNGIVLEDDSSIVYQSPTGLFKRSVKLVDL

SEQ ID NO: 975 - protein, 1365 aa, Artificial Sequence
  Cas9
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 976 - protein, 1365 aa, Artificial Sequence
  Cas9
MDTAKTNKQPYYIGLDMGTSSVGWAVTDASYNVVKKHGKALWGVRLFEEAQTAADRRLHRTARRRIQRRKQRLALLQELFAKEICKVDPGFFIRLHESRLWQEDKSIDQPNTLFNDEDFDDKAYHKAYPTIYHLRYALMTENKSFDVRLVYLAIHHIIKHRGHFLLENYDLSNQETSGFDESYIALTNAIKELLQKEIPVGHVEKIQIILKDKSLSKREKTEKILQVWDVIKDKQLKEVVQLICGGTANLSTLFMDESLKEALKVFEIKDSKISFSTAVYEEKESDLQSVLEQRFDLVYAAKMLYDWSLLAELMGDRKTLSEAKIAIYETHKKDLEVLKRLTRQDKSLYRKLFRGTDKDSYSAYVGSCMIHGEKLVIEKRGSTEEFYKFLKKEISKLPDCEDKIYVLSKIEAENFLPKAVSTINGIIPYQLQEQELDIILKKAEQYLPFLMEKDAYGTISEKIKQLLTFRIPFYVGPLNRHSDKSWAVHTDKEGRILPWNFNERINEEKSAEKFITRMTNKCTYLLGKDVLPKNSLLYTEYMLFNELNNVKIGKAGTYLTEEQKEKLWKELFLTTKKVTLSKFSKFLIKEGIDKEEAVEIKGLDGGFKSSLAPWIDLKNILGEDFTRDKAEEIIKAITLFSMDKKILKKYLMRIVSEPVAKQLSKLRYTGWGRFSKEFLTEITPRVTDDVQVLVDTSTGEIMNIITALKKTSLNLMEILSSTYGYSAAISEANKELVGNTVLSYETVKELTVSPAVKRPIWQTLKIIKEITHIMGAEPARIFIEMARDKQPDKGRTDSRKKQLIELYKKCKEDVRSWSNRESKDWVEEIESKSDSQLRSNKLFLYYTQMGKCMYTGKPIDLGALLKGQLYDRDHIYPQSQTKDDSLDNLVIVDNRENRDKSNTYPLSKNIRERQIGFWKLLRDKGFISKEKYFRLTRNTPFSDAEKAEFIARQLVETRQSTKAVAEILKRVLPKSIIVYVKAGLTSRFRQYGEFIKVRDLNDYHHAKDAYLNIVTGNVHYTKFTSNPIRFVKDCQIYSLNEHALYKYTVERNGVVAWAPNEEGMMPSVTRWMNKNNILVTRMSYVGQGELFDQLPLKKGKGQVSLKKEGAISDISKYGGYNSASTAYFMYVEGEDNKGKPVYVIETMPLHLAARLTTLEEKQKYCEELWMSTGGKLKNPKVLIEQIPIQSLFSVDGFRVTIAGKTGKQYGCRLAEELVLNNGYAMTLKAVLKFVNRRKMNKEALITSYDHLEESQLLALYDVFLDKLEHSCFSKRFSTQRDVLKNGRESYIALSLEDKCQILSEILHLFQCNATLSNLSLLGSSKQSGRLYMSKNLSDKDSWYIIHQSVTGFYEQHIPLAPYKKS

SEQ ID NO: 977 - protein, 1365 aa, Artificial Sequence
  Cas9
MVKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 978 - protein, 1366 aa, Artificial Sequence
  Cas9
MKKPYSIGLDIGTNSVGWAVITDDYKVPAKKMKVLGNTNKKTIKKNLIGALLFDAGNTAADRRLKRTARRRYTRRRNRILYLQEIFAAEMNKLDESFFHRLDDSFLVPEDKGGSKYPIFGTLEEEKEYHKQFPTIYHLRKSLADSKEKADLRLIYLALAHIIKYRGHFLYEDTFDIKNNDIQKIFNEFTSIYNNIFEESSLSNENAQVEEIFTDKISKSAKKDRVLKLFPDEKSTGLFSEFLKLIVGNKADFKKHFDLEEMAPLQFSKDTYDEDLESLLGQIGDDYADLFVVAKKLYDAILLAGILSVKDPATKAPLSASMIERYDNHQNDLSALKQFIRSNLPEKYAEVFSDDSKDGYAGYIDGKTTQEGFYKYIKNQISKFEGTKYFLEKIEREDFLRKQRTFDNGSIPHQIHLQEMNAILQNQGGYYPFLKANKERIEQILTFRIPYYVGPLARGNSDFAWLTRNSDDAIRPWNFEEVVDKASSAEDFINKMTNYDLYLPEEKVLPKHSLLYETFAVYNELTKVKFIAEAMKDYEFLDSGQKRKIVENIFKNHRKVTEKDIINYLHNVDGYDGIEIKGIEKQFNASLSTYHDLLKIIKDKEFMDNPKNGEILESIIHTLTIFEDREMIKQLLAQYNSVFDEKVIKALSRKHYTGWGKLSAKLINGIRDKQTGNSILDYLMDDGKSNRNFMQLIKDDGLSFKEIIDKAQVVGETDNLRQVVQNLPGSPAIKKGILQSIKLVDELVKVMGSDPESIVIEMARENQTTNKGKSKSQQRLKTLSDAISELGSNILKEHPTDNIQLQNDRLFLYYLQNGKDMYTGEALDINQLSNYDIDHIIPQAFIKDDSLDNSVLTSSKDNRGKSDNVPSLEIVEKMKGFWQQLLDSKLISERKFNNLTKVERGGLDERDKVGFIKRQLVETRQITKHVAQILDARFNAEVNEKNQKLRSVKIITLKSNLVSNFRKEFGLYKVREINDYHHAHDAYLNAVIAKAILKEYPKLEPEFVYGDYQKYDLKRYISRTKDPKEIEKATEKYFFYSNLLNFFKDKVYYADGTIIQRGNVEYSKDTGEIAWNKKRDFAIVRKVLSYPQVNIVKKTEEQTGGFSKESILPKGNSDKLIPRKTKNIQLDTTKYGGFDSPVIAYSILLVADVEKGKSKKLKTVKSLIGITIMEKVKFEANPVAFLEGKGYQNVVEENIIRLPKYSLFELENGRRRMLASSKELQKGNEMVLPSYLLALLYHAKKIQKKDEPEHLEYIKQHHSEFNDLLNFVSDFSQKYVLAESNLEKIKNLYIDNEQTNLEEIANSFINLLTFTAFGAPAVFKFFGKDIERKRYSTVTEILKATLIHQSITGLYETRIDLSKLGEE

SEQ ID NO: 979 - protein, 1366 aa, Artificial Sequence
  Cas9
MDKKYNIGLDIGTSSIGFVATDEDNHVIRAKGKNVIGVRLFDEGQSAAERRGFRTTRRRLNRRKWRLNLLREIFEPHIYPIDASFFMRQKYSNLSKQDPNQKIEFKDILFSDKSDAEFYRQYPTIYHLRQALMTEKRQFDLREIYLAIHHIVKYRGHFLDETPTDKFSFDQLDLTQEFERLNVLFSEQNPEEPFEIVVNQNQSIEDILSNQSMTASDRRKQALVVFYQQSENKENEKQYKAIATEILNLLLGNKAKLNVILAQEVDKEAAKDWSLSLSSETFDDDLEKASSGLNDSQLEMVGIFERIYSSLILKSIIGDHNSLSAAMVDKFKTHAQHRDLLKDVIKNSDATKGEQLQFAYDHYLQRHSADGKAYGKDDFYKEVKKNLDDSDAAQQIQQLIDTDQFMPKQRTKANGAIPHQVQQKELDLIIENQCQYYPWLAEENPNSERHNVAKYKLDELVSFRVPYYVGPLISPADDETDPQAIQNTKFAWMIRKDAQGRITPWNFDDKVDREKSADKFIKRMTTTDTYLIGEDVLPDQSLIYQRYKVLNELNNVRINGRPIEVQIKQNIYTDLFKKFKSVSVKKLRSYLEEMSYYPGSFKISGLTNPGKFDNGLTSYLDYKNILGDSVDANDKRADIEQMIEWSTIFEDNKIFAQKLESMTWLTAEQRKAISRKRYTGWGRLSNKLLTQLKNQDNRSIMDLLWETEENFMKIQSAPDFSKMIEAHNQQFIKNEANIQQVISDLYTSPQNKKAIRQILLVVDDIQKAVGHAPEHIAIEFAKGEDKNPRRTISREMKIQDVYQQISDDILVSPEVRAQLNEKIENRHGRLSDRLFLYFMQGGRDMYTGKPININNISHYDIDHILPQAFIKDDSLDNRVLVSDKLNREKSDTVPRDLFGREMMSTWEKMADRGLITKRKLANLKTIPGSIDAHKAQGFINRQLVETRQVIKLAVGIMIDQYPETQIVSVKANLTHEMREMFDLVKNRDVNDYHHAFDAYLTAFVGNYLLQRYPKLEPYFVYDKFKKLKDQNISMRDFNLLYDLKKNEDVYDQRTGHSAHKIWDQHGSIDYIRHLFAYKKILVSHEVHQNGGALYNMTVYGKADDAKRKLIPIKADKPTELYGGYTSRKLAYMAIVKTKKGKKEQYQVTGVPVSALTTLRQFKEDSPEQKQALEEIVRRNFDEKTEVEIIVPKVLFNQLIVDEKCRFMVGSDTYRYNAQQLVLSADDLEIINASHKDIQTIDSSDYSQQLDQVYQNILTIVDKHFPMYDINKFRTKLHDIYEQYIELPNEDVWENNKLTTLGKHTIIIRILQGLHANATVVDLKQLGIKTPFGFMQQARGIVVSPDAQLIYQSPTGLYERRVRLGDL

SEQ ID NO: 980 - protein, 1366 aa, Artificial Sequence
  Cas9
MGDRKYNLGLDIGTSSIGFAAVDENNQPIRVKGKTAIGVRLFEEGKTAADRRGFRTTRRRLSRRRWRINLLNGIFDAHLAEVDPTFLARLKESNRSNLDPKKSFQGSLLFPERKDYQFYKEYPTIYHLRKALMEEDRKFDIREIYLAVHHIIKYRGNFLNGTPMRSFKVENIELDTLFDRLNQLYEEIIPDNELAFDLEQVADVKEVLSSTTIYKMDKKKQLVKMMLLPTSNKALQSENKKIVTQFVNAILNYKFKLDVLLQVETDADWSLKLNDEGADDKLEEFTGDLDENRLEIIDLLQRLHNWFSLNEITKDGNSLSAAMVEKYKDHRHHLELLKKVIEDHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNGENVFAWMKRKVAGPITPWNFDKKVDRMESANRFIRRMTTKDTYLFGEDVLPAESMIYEKFVVLNELNNLKINGRHLSLKDKQDIYNDLFKQQKTVSIKALQNYYVTKKKAATAPTVGGLADPKKFLSSLSTYIDFKNMFGEQVNDPQFQEDLEQIVEWSTIFEDRGIFKAKLQALGWLSEKQIQQLVAKRYKGWGRLSKKLLTGLKNAEGYSILDEMWRSTENFMQIQSRPEFAALIQQANEKQFEGNDPNNVWENIENILGDAYTSPQNKKAIRQVVKVVQDIEKAVGNPPEKIAIEFTREAAANPQRTQSRLRTLEKLYESAEEVVDARLTAELAEFKENKHVLSDKYYLYFTQLGRDVYTGDTISLDRLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLRPYFVYGKFKKFSDNEDIEVGDGRFNFLNRIERLKNVTDPETGEILWSNVAPNETIKRIKKVYNYKFMIVSREITTRRAELFNQTVYPKNYRGKLIPIKEDRPTDLYGGYSGNTDAYLAIVALEDKKKGKYFKVVGIPTRAAAKLEKLKQQDSQQYLQAVHEVIAPQFTKSTKKGIKKTEFRIVLDKVHYRQLVQDGPVKMMLGSSTYKYNAKQLVLSEKALQVIKDDRKFDETQKDDNLIAVYDEILSIVNQSFDLYDINGFRKKLNDNRNQFIDLPAETKYEGRKVVAHGKREMILEILKGLHANASFGNLKPIGFATPFGQMQSKNGIELSENAFLIHQSPSGLFEHKIKLSDL

SEQ ID NO: 981 - protein, 1366 aa, Artificial Sequence
  Cas9
MTKLGKPYGIGVDIGSNSIGFAAVDENSHLIRLKGKTVIGARLFEEGKAAAYRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAKEGDRDILKQQKQVLTEFAKAVVGLKTKLNVALGTEVDSSEATAWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQAVYYDWLAAPNPVEKHRQSMTYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGEFEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQIEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 982 - protein, 1366 aa, Artificial Sequence
  Cas9
MTKDYSLGLDIGTGSVGFAALDTNYRLLRAKGNNVIGVRLFTPAETAEERRGFRTARRRLSRRRWRLGALNGIFAPELAKVDPNFLHRLKYAWVHPADQQNKGKYSAAPLFNDAALDRQFHDDYPTIYHLRLKLMTDTSQHDLREVYLAIHHIIKFRGNFLRGEGPINASEAFDINTFIDQMTAFYDQAFPDFKIVDQVDQQIIFKGLTDMTLSPADRANKALMGFNNAAQQPNKRIFKAILSGLVGNQVDLMAIFQLDGIPKEDQKEFKFKFVDNDIEEKLAALGDNPALSDEQNEFLTTLYAAFSGLTLKGLLGDATSISAAMVARYASHRTDWTYIKDHVLTPQNNRELRLAYADLMTDNEDVRLKAGKKFAKAIEAADIPAAKKSEFSLKIDNNEFLPRQRTKANGTIPHQLHLNELQQIIENQGQYYPFLKATFEQDGHTLNKIEGLVKFRVPYYVGPLVPKHKVAGNNANHWMVPKEPGAITPWNYTEKVDRDKSGNEFIRRMTGTDTYLLGEPTLPKNSLVYQEFNVLQELNNLRIEKRRLDIAVKQDIFEHVFKTNKTVTVKRIEEYLTTEFGSPVTLSGFANVNERKLNSSLSTYHYFVGIFGAEFVDDPKNLTLLEQIVELQTVFEDRKALQRQLKLRPELSEKQVKQLARTHYTGWGRLSQKLLTSKIVHVALEGEREPGQYSILETLYGTQMNFMEIVNDMKDRYGVKSWLDQENSGSENNLSLKQRILDMPGPKNIKRGINQAFHIIDEITRAVGNAPSRIYIEFARESQQSNLTNARVNRLKQLYSNQALKKEFAKLASEIKDLTKEQLKDDRLYLYYLQQGKDMYTETDIDITKISSNYQIDHIIPQAYTKNNSLDNRVLVNSEMNARKSDSPTFLPSLIQERKAWWRQLRDTGLMSTIKYNNLTRTSDDFSADQKERFIARSLVETRQVIKNVATLIKEYYDDSQVEALPSEITAEMRRYLNVRKNRDINDYHHAHDALLFATAGEFSRKVGIMEKGRVSDGAGNIYNRYTKDIIQRARAKAGQDKKVRPFTFIVGSMANPDTKFQTNQTTGEIVWTPEDVAYLRKVIDYKKMLVTKMTLDQTGTLYNETRYGSGDKHVAVALSKDKAADLYGGFGSLKPAYAALVYSKKKFRLVNVLRLWLPEIKKNASVLERKVQSVLGDDNAKVIRAHVPCGQLLIKDGALVTVSSATELHNFRQLWLPKADYQDISILLGAPDKVTAENRLQAESHFDDVDQRFESLLKDVIDQARQYYPLKTHQTSLEKLIGKIGKFDELKFAQKQQVFSRLLSALHANATNSDLKQIGLSTAWGRLIYPKGVSLTDEDKLINSSFTGLFNDVMSIKEFHDFSIN

SEQ ID NO: 983 - protein, 1367 aa, Artificial Sequence
  Cas9
MKKQKFSDYYLGFDIGTNSVGWCITDLDYNVLRFNKKDMWGSRLFEEAKTAAERRVQRNSRRRLKRRKWRLNLLEEIFSNEILKIDSNFFRRLKESSLWLEDKSSKEKFTLFNDDNYKDYDFYKQYPTIFHLRNELIKNPEKKDIRLVYLAIHSIFKSRGHFLFEGQNLKEIKNFETLYNNLIAFLEDNGINKIIDKNNIEKLEKIVCDSKKGLKDKEKEFKEIFNSDKQLVAIFKLSVGSSVSLNDLFDTDEYKKGEVEKEKISFREQIYEDDKPIYYSILGEKIELLDIAKSFYDFMVLNNILADSQYISEAKVKLYEEHKKDLKNLKYIIRKYNKGNYDKLFKDKNENNYSAYIGLNKEKGKKEVVEKSRLKIDDLIKVIKGYLPKPERIEEKDKTVFNEILSKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDTFLYSEYVILNELNKVQVNDEFLNEENKRKIIDELFKENKKVSEKKFKEYLLVKQIVDGTIELKGVKDSFNSNYISYIRFKDIFGEKLNLDIYKEISEKSILWKCLYGDDKKIFEKKIKNEYGDILTKDEIKKINTFKFNNWGRLSEKLLTGIEFINLETGECYSSVMDALRRTNYNLMELLSSKFTLQESINNENKEMNEASYRDLIEESYVSPSLKRAIFQTLKIYEEIRKITGRVPKKVFIEMARGGDESMKNKKIPARQEQLKKLYDSCGNDIANFSIDIKEMKNSLISYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGQLFDLNPIKKGETSNEIISIKPKVYNGKDDKLNEKYGYYKSLNPAYFLYVEHKEKNKRIKSFERVNLVDVNNIKDEKSLVKYLIENKKLVEPRVIKKVYKRQVILINHYPYSIVTLDSNKLMDFENLKPLFLENKYEKILKNVIKFLEDNQGKSEENYKFIYLKKKDRYEKNETLESVKDRYNLEFNEMYDKFLEKLDSKDYKNYMNNKKYQELLDVKEKFIKLNLFDKAFTLKSFLDLFNRKTMADFSKVGLTKYLGKIQKISSNVLSKNELYLLEESVTGLFVKKIKL

SEQ ID NO: 984 - protein, 1367 aa, Artificial Sequence
  Cas9
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 985 - protein, 1367 aa, Artificial Sequence
  Cas9
MKKQQFSDYYLGFDIGTNSVGWCVTDFNYNVLRFNKKDMWGSRLFDEAKTAAERRVQRNSRRRLKRRKWRLNLLEEIFSDEILKIDSNFFRRLKESSLWLEDKSSKEKFTLFNDDNYKDYDFYKQYPTIFHLRNELIKNPEKKDIRLVYLALHSIFKSRGHFLFEGQNLKDIKNFETLYNNLMAFLEDNDIYKNIDSSYIGNLENIICDSKKGLKDKEKEFKEIFNSDKQLVGFFKLSVGSSVSLNDLFDTDEYKKGEVEKEKISFREQIYEDDKPIYYSILGEKIEFLDIAKSFYDFMVLNNILADSQYISEAKVKLYDEHKRDLKNLKYIIRKYNKENYDKLFKDKNESNYSAYIGLNKEKGKKEVIEKSRLKIDDFAKIIKGYLPKAEKIDEKDRSIFNEILDKIELKTILPKQRISDNGTLPYQIHEAELEKILENQAKYYDFLNHEENGISTKDKLLMTFKFRIPYYVGPLNSYHKNKGGNSWIVRKEEGKILPWNFEQKVDIEKSAEEFIKRMTNKCTYLNGEDVIPKDSFLYSEYIILNELNKVQVNDEFLNKEIKKKIIEDLFKKSKKISEKNFREYLLVNQITNKTVELKGVKDAFNSNYVSYIKFKDIFGDKLNLDIYKEISEKSILWKCLYGDDKKIFEKKIKSVYGDILTKDEIKKINSFKFNTWGRLSEKLLTEIEFIDLETGECYSSVMDALRRTNYNLMELLSSKFTLQENIDNENKEVSEFSYRDLVEESYVSPSLKRAILQTLKIYEEIRKITGRIPKKVFIEMARGGDETMKNKKIPARQEQLKKLYDSCGKDISNFSIDIKEMKNSLNSYDNNSLRQKKLYLYYLQFGKCMYTGKEIDLNRLLQNNDTYDIDHIYPRSKVIKDDSFDNLVLVLKNENAEKSNEYPLKKEIQEKMKSFWKFLKEKNFISDEKYKRLTGKDEFELRGFMARQLVNVRQTTKEAGKILQQIEPEIKIVYSKAEIASSFREMFDFIKVRELNDTHHAKDAYLNIVAGNVYNTKFTEKPYRYLQEIKENYDVKKIYNYDIKNAWDKEKSLEIVKKNMEKNTVNITRFIKEEKGQLFDLNPIRKGETSNEIIAIKPKFYEGSTEKLNEKYGYYKSLNPAYFIYVEHKEKNKIIRSFERVNLVDVNKIKDEKSLIKYLIENKGLIEPKVIKKVYKRQVILINNFPYSIVALDSNKLMDFENLKPLFLERKYEKILKNAIKFLEDNQGKTEEYYKFLYLKKKDRNEKNETIDSVKERYNIEFNEMYDKFLEKLDSKDYKNYINNKKYSELVNVKEKFIKLNLFDKAFTLKSFLDLFNRKTMADFSKVGLTKYLGKIQKISSNVLSKNELHLLEESVTGLFVKKIKL

SEQ ID NO: 986 - protein, 1367 aa, Artificial Sequence
  Cas9
MKDYYLGLDMGSSSVGWALSDERYNLLRAKGKDLWGVRLFDEAKTAAERRTFRSQRRRLERSKWRLSLLTSLFEEEISKIDDKFFDRLKDSKFFIDDKSDQQPNTLFNDVNFTDKEYHKRYPSIYHLRNALFNQNDKFDIRLIFLALSHIVKKRGHFLFDGDKAGFGEDIDVILDELKAYLQDAFHTKLEFTSEFKSIMLDKNLRKKQKEEELKNSIKISSDTINSKDGKSILIKLFLGYEANLKPFFLEYKVEKDNEYKINFSKEDYEEKLLDMTSKFEETTYFIEIAKKIHDYFLLEEIMLGFKNISASKVSIYQKHKNDLKTLKNIVKNQINNSYNAIFKDIGLDNYPAYVSCWNSKKHKEKQKGCTKDKFYAFLKTKLKNINNAKEILDSIDNDDFLPRLVDKNSIIPHQIHLAELIKIIDNQSQYYPFLKEIKDKIISIFKFRIPFYVGPLNNFHKDKGGNAWIEKLKDERIFPWNFNDVVDLNKSAANFIEKMINECSYLKGEKVLAKNSLLYTKYSVLNLINKLKINGTAVSVETKQKIYNELLLKQKNIKKTAIKKFLINNSIIDKNDEISGIDDSLTSNLAVFIDFEKISNRLRYDQKEDIIKSISLFGYDNAMLKKQIITIAPDLSEDELEKLSKLRYSGFGRLSKRLLTSIKHNGKSIIEMLWDTNDNLMELLSDRYTFIEQINKHNDGFKEDINLNFQNVDTLYVSPSVKRQIWQAFKVINELISVMGREPKKIFVEMAREEGEKKRTQARKDKVLELYKSIKNNEISTFLTNFKDIKTKLEGESNLNSKKLYLYYLQLGVDIYTGEKIPFEKLFDQNIYDIDHVIPRSLKKDDSFDNLVLTSKTNNAKKTDEFPVSSEIQSKMQTFWKVLKDKDLMSEIKYTNLTRKTHLSDDELGDFIARQLVETRQSTKALTQILKNVYANSDIVYVKAGIVSEFRQQFDMLKIRELNDFHHANDAYLNIVIGNVYNIKFTKNPRNYVKEYYKKGEHYNLKIEKMLEKDIARGGNFGWDKKHSIETVQKTMKKQSPLITYRTFENKGEFFNQQPSKASANLLALKSSDKRLLDTVRYGGYKGTQYAHMFLVEHFNGKIIKEIMGVPIYLSKEIKDDKAKLLEYCNDVLKLKNPKILFSKIPYNSLIVYNGYPILLRGLTGVRGAAQLKLDQTSTQVVKNIVKLYDWLSQKQKELSDLSKKIEFFQENNKKDEVKAAMLEADNILFILNDRFKNTKIGKDIMNDNHLNNLYDTFINKLENSIYKNKPGGKQDVLMKEKRDLFLSFSMSKKCITLYKIIKIFGSCDQGVDFSDIAEKISKSGGIGGKNLGKNTFDLVFKENSTYTLVQSSVTGLYAKKTDLHKL

SEQ ID NO: 987 - protein, 1367 aa, Artificial Sequence
  Cas9
MKKQKFSDYYLGFDIGTNSVGWCVTDLDYNVLRFNKKDMWGSRLFEEAKTAAERRVQRNSRRRLKRRKWRLNLLEEIFSNEILKIDSNFFRRLKESSLWLEDKSSKEKFTLFNDDNYKDYDFYKQYPTIFHLRNELIKNPEKKDIRLVYLAIHSIFKSRGHFLFEGQNLKEIKNFETLYNNLIAFLEDNGINKIIDKNNIEKLEKIVCDSKKGLKDKEKEFKEIFNSDKQLVAIFKLSVGSSVSLNDLFDTDEYKKGEVEKEKISFREQIYEDDKPIYYSILGEKIELLDIAKTFYDFMVLNNILADSQYISEAKVKLYEEHKKDLKNLKYIIRKYNKGNYDKLFKDKNENNYSAYIGLNKEKSKKEVIEKSRLKIDDLIKNIKGYLPKVEEIEEKDKAIFNKILNKIELKTILPKQRISDNGTLPYQIHEAELEKILENQSKYYDFLNYEENGIITKDKLLMTFKFRIPYYVGPLNSYHKDKGGNSWIVRKEEGKILPWNFEQKVDIEKSAEEFIKRMTNKCTYLNGEDVIPKDTFLYSEYVILNELNKVQVNDEFLNEENKRKIIDELFKENKKVSEKKFKEYLLVKQIVDGTIELKGVKDSFNSNYISYIRFKDIFGEKLNLDIYKEISEKSILWKCLYGDDKKIFEKKIKNEYGDILTKDEIKKINTFKFNNWGRLSEKLLTGIEFINLETGECYSSVMDALRRTNYNLMELLSSKFTLQESINNENKEMNEASYRDLIEESYVSPSLKRAIFQTLKIYEEIRKITGRVPKKVFIEMARGGDESMKNKKIPARQEQLKKLYDSCGNDIANFSIDIKEMKNSLISYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEKKGQLFDLNPIKKGETSNEIISIKPKVYNGKDDKLNEKYGYYKSLNPAYFLYVEHKEKNKRIKSFERVNLVDVNNIKDEKSLVKYLIENKKLVEPRVIKKVYKRQVILINDYPYSIVTLDSNKLMDFENLKPLFLENKYEKILKNVIKFLEDNQGKSEENYKFIYLKKKDRYEKNETLESVKDRYNLEFNEMYDKFLEKLDSKDYKNYMNNKKYQELLDVKEKFIKLNLFDKAFTLKSFLDLFNRKTMADFSKVGLTKYLGKIQKISSNVLSKNELYLLEESVTGLFVKKIKL

SEQ ID NO: 988 - protein, 1367 aa, Artificial Sequence
  Cas9
MKKQKFSDYYLGFDIGTNSVGWCVTDMNYNVLRFNKKDMWGSRLFEEAKTAAERRVQRNSRRRLKRRKWRLNLLEEIFSNEILKIDSNFFRRLKESSLWLEDKSSKEKFTLFNDDNYKDYDFYKQYPTIFHLRNELIKNPEKKDIRLVYLAIHSIFKSRGHFLFEGQNLKEIKNFETLYNNLIAFLEDNGINKSIDKDNLEKLEKIVCDSGKGLKDKEKEFKEIFNSDKQLVAIFKLSVGLSVSLNDLFDTDEYKKGEVEKEKISFREQIYEDDKPIYYSILGEKIELLDIAKSFYDFMVLNNILADSQYISEAKVKLYEEHKRDLKNLKYIIRKYNRENYDKLFKDKNESNYPAYIGLNKEKSKKEVIEKSKLKIDDLIKSIKGYLPKVEEIEEKDKAIFNEILNKIELKIILPKQRISDNGTLPYQIHEAELEKILENQSKYYDFLNYEENGIITKDKLLMTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIEELFKGNKKVSEKKFKEYLLVNQITTGTIELKGIKDSFNSNYISYIKFKDIFGEKLNLDIYKEISEKSILWKCLYGDDKKIFEKKIKNEYGDILTKDEIKKINTFKFNNWGRLSEKLLTGIEFINLETGECYSSVMEALRRTNYNLMELLSSKFTLQENIDNENKDISQFSYRDLVEESYVSPSLKRAILQTLKIYEEIKKITGRVPKKVFIEMARGGDESMKNKKIPARQEQLKKLYDSCGNDIANFSIDIKEMKSSLSLYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYSYDIKNAWDKENSLEIVKKNMEKNTVNITRFIKEEKGQLFDLNPIKKGETSNEIISIKPKVYNGKDDKLNEKYGYYKSLNPAYFLYVEHKEKNKRIKSFERVNLVDVNNIKDEKSLIKYLVENKKLVEPRVIKKVYKRQVILINDYPYSIVALDSNKLMDFENLKPLFLERKYEKILKNVIKFLEDNQGKSEENYKFIYLKKKDRYEKNETLESVRERYNIEFNEMYDKFLEKLNSKDYKNYINNKKYQDLLDVKEKFIKLNLFDKAFTLKSFLDLFNRKTMADFSKVGLTKYLGKIQKISSNVLSKNELYLLEESVTGLFVKKIEL

SEQ ID NO: 989 - protein, 1367 aa, Artificial Sequence
  Cas9
MVKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLTLALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 990 - protein, 1367 aa, Artificial Sequence
  Cas9
MVKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKSATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 991 - protein, 1368 aa, Artificial Sequence
  Cas9
MDKKYSIGLDIGTSSIGFVGVDENGWPLNIKGKRAIGAHLFREGEAAAETRGFRTTRRRYNRRKWRLRLLREIFDEPISRVDPTFFARMKESSVSPKDPNYDGLAKEILIPRDKDGKILYPTIYHLRHALMYEDHQFDIREIYLAIHHIVKYRGHFLLDGAAKNFESSNLDLKSDIHEINAILVGIFGNEQVQFNDQYVEKLKEVLLDSTQSRSDRQKAAAKVLLPTNDLDKDTTKILKTVSTEITKAITGLKAKFFVITGNDIAKDQQKDWTFSIDTLDEKMSVIEPSFSEKNFSLITILQKLYSSVTLAGIVPNGLSLSEAMIQKYDRHASDLVLLKKYWDTKPKVLKHQLQNTYAEYIEIHQVVDEFYSDLSKLIKNDDDTLAQEIKSKITIGNFLPKQRTTENGVIPYQLQQRELDTIIKNQQEYYPWLAEENPVADHQIAFPYKLDELVGFRIPYYVGPMIAKEDTSNSKNSKFAWMIRKQSGEVTPWNFDEKIDRTASATAFIDRMTTTDTYLIGEDVLPKQSLIYQRFEVLNELNKISIDGQPITRKQKQSVYTHVFEKKKTVQVKDVQKFLVSSGEVMSLPKIGGLANEKQFNSSLSTLYDYNKIIPDALEDRNKVDDIEKIILWSTIFEDNSIFVEKLDSIDWLTSSQRKRLAQKRYRGWGRLSLRLLTTFKNKDGYSILDELWNSNHNFMEIQAQSDFSEQIATANNNNLSQVLPAKWEPGRKNLASLDEFISNLYTSPQNKKALRKAIRVVQDMMTAAGHMPEKIFIEVARDTSNSHQQTIARQRQLQQLYQSEAKEVIDSSVRSELDDILKNRANIKDQLFLYFQQGGRDLYTGKAINIDKLSLYHIDHILPQSLVKDDSLDNRVLVSQKTNEDKGVTFVSDKYMNNMLPTWKRWHEMGLISARKLKNLTMRPDEIDKYAPGFIQRQLVETRQVTKLVIELLDALLGNSQTEIITIKASLSHQFRQQFDLVKIREVNDNHHAFDAFLAARIGTYLYKRYPKLRPYFVYGQYMQNHKNLKSINLIKTLDSDKAIVDEGTGEILWDKKSDLAKMIKIYNYQRLLITHESRTSFGAMYKQKILKATDAKQNGGGFKLVPTKRNWPVDIYGGYTGQTAAYLTIVRVYSKKTSELRVLPIYTNKVQQIEKAMTQGDKATMLAFKKVIAPQLGKENKKTHEIKIPEFDVVIPKVLLDQLVIDDIAGSPHRFRLGTDTYYHNSQQLFLPLSMQRQLMDRESDDKVYLDIFNDVLKQVDSYFNLYDVNGFRAALQKSKKAFEQLPINDFPKDVPDNKKKKGKRSILKEIFIGLHANATLGNLKQMGIKTDFGKLQKSNGLRITENCKIIHQSPTGLFERIVPIK

SEQ ID NO: 992 - protein, 1368 aa, Artificial Sequence
  Cas9
MSRPYNIGLDIGTSSIGWSVVDDQSKLVSVRGKYGYGVRLYDEGQTAAERRSFRTTRRRLKRRKWRLGLLREIFEPYITPVDDTFFLRQKQSNLSPKDQRKLYPQTSLFNDRTDRAFYDDYPTIYHLRYKLMTEKRQFDIREIYLAMHHIVKYRGHFLNEAPVSSFKSSEINLVAHFDRLNTIFADLFSESGFQLETDKLAEVKALLLDNQQSASNRQRQALSLIYTPSTNKAVEKQNKAIATELLKAILGLKAKFNVLTGIEAEDVKAWTLTFNAENFDEEMVKLESSLDDNAHQIIESLQELYSGVLLAGIVPENQSLSQAMITKYDDHQKHLKMLKAVREALAPEDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQRQSSDAKFAWLIRKAEGRITPWNFDDKVDRQASANEFIKRMTTTDTYLLAEDVLPKQSLIYQRFEVLNELNGLKIDDQPITTELKQAIFTDLFMQKISVTVKNIQDYLVSEKRYASRPAITGLSDENKFNSRLSTYHDLKMIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNPRLSVQRKRQVEQVYQNISNELLNNTEIRNELKDLSNSALSNTRLFLYFMQGGRDMYTGDSLNIDRLSTYDIDHILPQSFVKDNSLDNRVLVSQKMNRSKADQVPTDFTSVELGKKMQLQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWDKESGLAYLNKIYQFKKILVTREVHENSGALFNQTLYAAKDDKASGQGGKQLIPAKQDRPTALYGGYSGKTSAYLCLVKIKNKSEYIYRIFGVNTSWSSELKQIQDPAERLVRLEKLLTPQLTINKKKKGEPVPVTKDFKIILPRILINQKFYSRGQDISIASEFYLHNEQELVLDKSDIKILNGAIKVNNSNKQVINLFNHILEQVNQYFPVYDIYKSREVLNSSKEIFENLTWNDQWRNRKLINVGQKTILNRILIGLHANAARIKISELGFKNDFGLLTQTSGITFTPDTQIIYQSPTGLFERRVALRDL

SEQ ID NO: 993 - protein, 1368 aa, Artificial Sequence
  Cas9
MKRSYNIGLDIGTNSIGWAIVDDQSKLISVKGKYGYGVRLYDEGQTAAERRSFRTTRRRLKRRKWRLGLLREIFEPYITPIDSTFFLRQKQSNLSPKDQRKLYPQTSLFNDRPDADFYQQYPTIYHLRYQLMTEKRQFDIREIYLAMHHIVKYRGHFLNEAPVASFKSSEINLAEHFDQLNTIFADLFRESGFQLETDELVAVKALLMDNQQSASNRQRKALPKLYTPSADKSIEKQRKAIATEILKAILGLKAKFNVVTGIEAEDVKAWALTFNAENFDEELAKLESSLDDNGHEVIGILQELYSGILLAGIVPENQSLSQAMITKYEEHQAHLKMLKAVRDDLATADQQKLKKAYDQYIDGQENTKAYSKEAFYDDVTKALKDYSEQPLVSEIQKLIELDQFMPKQRTKDNGAIPHQLHQQELDRIIENQQQYYPWLAELNPNPKRQTVAKYKLDELVAFRVPYYVGPLITAEQQQQSSNAKFAWMIRKTEGRITPWNFDDKVDRQASANEFIKRMTTTDTYLLAEDVLPKQSLIYQRFEVLNELNGLKIDDQPITNELKQAIFNDLFMQKTSVSVKNIQDYLVSEKRYASRPAITGLSDEKKFNSRLSTYHDLKVIVGDAVDDVDKQADLEKCIEWSTIFEDGKIYSAKLNEITWLTEQQRGQLATKRYRGWGRLSAKLLTQIVNANGQRIMDLLWDTTDNFMRIVHFEDFDKLITEANQMVLAENDVQDVINDLYTSPQNKKALRQILLVVNDIQKAMKGQAPERILIEFARGAQKDKSLTVRRKRKLDEMYSQISDAVLADESVRQELKSSNQDDLVKEKVYLYFMQGGRDLYTGNALNIDRLSDYHVDHIIPQAYIKDDSLDNKALVSSRMNEIKADRVPLQVVQKQFGKNMASEWGYMHRAGLISRKKYDNLMFNPENLNKYQINRFISRQLVETQQVIKLVANLLSNQYEGDNVKIITVKSKLTQTIRSEFDFPKNREVNNYHHAFDAYLTAFVGMYLLKRYPKLSSYFTYGEYLKGNQQDKWSSFNFLNDLKRAKLEDKTNKEIFWHKESGLAYLNKIYQFKKILVTREVHENSGALFNQTLYAAKDDKASGQGGKQLIPAKQARPTALYGGYSGKTVAYMCIVRIKNKKGDLYKVCGVETSWLAQLKQLKDEDSQKAFLKQKISPQFTKAKKQKGTIVKVVEDFEVIAPHILINQRLFDNGQELTLGSATYKHNEQELILDKTAVKLLNGELPLAQSEELAELVYDEILDQVMHYFPLYDTNQFRAKLLAGKTAFMQLPWKSNPDDNKTVQITQPIVLKKILQGLHADAGRVSLKELGMTTDFGMLQKATGITFTPDTQIIYQSPTGLFERRVALRDL

SEQ ID NO: 994 - protein, 1368 aa, Artificial Sequence
  Cas9
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 995 - protein, 1368 aa, Artificial Sequence
  Cas9
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 996 - protein, 1368 aa, Artificial Sequence
  Cas9
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNFGAPAAFIYFDTTIGRNRYKSIKEVLDATLIHQSITGLYETRIDLSQLGGD

SEQ ID NO: 997 - protein, 1368 aa, Artificial Sequence
  Cas9
MKYESEEYYIGLDMGTSSVGWAVTDPHYHLIRKKGKDLWGARLFEKANTAQERRTNRINRRRNQRRKQRIAFIREAFRKEVEKVDVNFFRRLDESQLYLEDKSIKEPYLLFNDLNYTDKDFYHQYPTVFHLITDLLTSDRKFDIREIYIAVSSLYNHRGNFLNKSLGNETQDEDLVFKNLDEAFSACGMNWNTKAENIEVVKQILCDRSLNKKEKQDQLAHCLEINKKTEKEKIEFLKLLTGGKADSKKMFPQYHYERDEKLSFAFADENGDENWEETLNAIEERLTSDEYGLILALKSVYDWSILADLMKNEKTGETYPYLSMARKDSYEKHKADLRLLKSVIKRLIPNEYNHFFRQYDGKGKTYTNYIGSVQYHEKRHRFKHITTKEFYDGLKKLLKPYSEDEEIKQILQDIESETFLPKQITNMNGVIPNQVHAKELKVILEKASQHYDFLNETNESGLTVKEQIMQMFTFQIPYYVGPLANLNGKGNGWAVRYVGKERTKVYPWNMDEVIDEKETADQFIKRMISTCTYLGDEYVLPKSSILYEKFAVLNELNSLKINGQPVSVDLKQKIYRDLFTKGKRVTQKGLLLYLKREGVISKSEETILSGFDIDFKNTLSSYRKFCEVFATNELNDEQIRMAEDIIEWLTVFGDSKKFVREKIHGNYPQITANQLKRILSFNFKDWGKLSKQFLELEGEDRETGKSCSLIQALWDTNNNLNQLLSSRFTYKENLEKKRKKIEMDLFEFTHEDLDDLYISAPVKRMIWQALKIMKDIVIVMKESPTKLFIEMTRNNENEKTRTVSRKNKLVDLYKKIKGESRDWIKELERYEEKDFRSKKLYLYYTQMGKSAYSGEPIDMDKLFDKNVYDIDHIYPKSKVKDDSLLNNCVLVKRKENMDKGNNFPIDPDIQTKQEHLWKFWLEKGLITQEKFNRLTRKKPFTNDELADFVNRQLVETGQATKTIADLFKMTFPNSDIVYVKAGNVTDFRQYIEVYKCREVNNLHHAYDAYLNVVVGNVYDTKFTKNPMNYIKEQRKENSNERYHMDKIFEFPVIRNGKEAWITKKDESINIVRKTLARKTPLVTKRNFEANGTIAKATIYPKGNVKDQGYLPRKTSIPALRDMKKYGGVTSIQIAYFFLVEHEVKKKRIRTIECVPIYRKEELKTKEQLERYCREELKLINPSIRLEKIKPYSLLKMNGNFFYITGKTNDRFSLANAMELYVDKVSENHIRDLVKYKNCGYFNVDDKEARKRNERLYTILTKKHLTVFKGSPKPMGEKLQQYQQLFLELEVSKQVYVLLQILQLTATNVKTKADLTAIGGKANEGTMDISKNLENVIKNQIKKGLVPELMLINQSPTGLFESEIDLLTI

SEQ ID NO: 998 - protein, 1368 aa, Artificial Sequence
  Cas9
MSRPYNIGLDIGTSSIGWSVVDDQSKLVSVRGKYGYGVRLYDEGQTAAERRSFRTTRRRLKRRKWRLGLLREIFEPYITPVDDTFFLRKKQSNLSPKDQRKLYPQTSLFNDRTDRAFYDDYPTIYHLRYKLMTEKRQFDIREIYLAMHHIVKYRGHFLNEAPVSSFKSSEINLVAHFDRLNTIFADLFSESGFQLETDKLAEVKALLLDNHQSASNRQRQALLLIYTPSTNKAVEKQNKAIATELLKAILGLKAKFNVLTGIEAEDVKTWTLTFNAENFDEEMVKLESSLDDNAHQIIESLQELYSGVLLAGIVPENQSLSQAMITKYDDHQKHLKMLKAVREALAPEDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQQQSSDAKFAWMIRKAEGQITPWNFDDKVDRQASANEFIKRMTTTDTYLLAEDVLPKQSLIYQRFEVLNELNGLKIDDQPITTELKQAIFTDLFMQKTSVTVKNIQDYLVSEKRYASRPAITGLSDENKFNSRLSTYHDLKTIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNPRLSVQRKRQVEQVYQNISNELLNNTEIRNELKDLSNSALSNTRLFLYFMQGGRDMYTGDSLNIDRLSTYDIDHILPQSFIKDNSLDNRVLVSQRMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWNKESGLAYLNKIYQFKKILVTREVHENSGALFNQTLYAAKDDKASGQGGKQLIPAKQDRPTALYGGYSGKTVAYMCIVRIKNKKGDLYKVCGVETSWLAQLKQLTDEDSKKAFLKQKISPQFTKVKKQKGTIVKVVEDFEVIAPHILINQRFFDNGQELTLGSATYKHNEQELILDKTAVKLLNGALPLTQSEELAEQVYDEILDQVMHYFPLYDTNQFRAKLSAGKAAFMKLPWKSQWDGNKMVQVGQQVILDRVLIGLHANAAVSDLGVLKISTPLGKMQQPSGISLSPDTQIIYQSPTGLFERRVALRDL

SEQ ID NO: 999 - protein, 1368 aa, Artificial Sequence
  Cas9
MSRPYNIGLDIGTSSIGWSVVDDQSKLVSVRGKYGYGVRLYDEGQTAAERRSFRTTRRRLKRRKWRLGLLREIFEPYITPVDDTFFLRQKQSNLSPKDQRKLYPQTSLFNDRTDRAFYDDYPTIYHLRYKLMTEKRQFDIREIYLAMHHIVKYRGHFLNEAPVSSFKSSEINLVAHFDRLNTIFADLFSESGFQLETDKLAEVKALLLDNQQSASNRQRQALSLIYTPSTNKAVEKQNKAIATELLKAILGLKAKFNVLTRIEAEDVKAWTLTFNAENFDEEMVKLESSLDDNAHQIIESLQELYSGILLAGIVPENQSLSQAMIMKYDDHQKHLKMLKAVREALAPEDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQRQSSDAKFAWLIRKAEGRITPWNFDDKVDRQASANEFIKRMTTTDTYLLAEDVLPKQSLIYQRFEVLNELNGLKIDDQPITTELKQAIFTDLFMQKTSVSVKNIQDYLVSEKRYASRPAITGLSDENKFNSRLSTYHDLKAIVGDAVEDVDKQVDLEKCVEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNPRLSVQRKRQVEQVYQNISNELLNNTEIRNELKDLSNSALSNTRLFLYFMQGGRDMYTGDSLNIDRLSTYDIDHILPQSFIKDNSLDNRVLVSQKMNRSKADQVPTDFTSVELGKKMQLQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWDKESGLAYLNKIYQFKKILVTREVHENSGALFNQTLYAAKDDKASGQGGKQLIPAKQDRPTALYGGYSGKTVAYMCIVRIKNKKGDLYKVCGVETSWLAQLKQLTDEDSQKAFLKQKISPQFTKVKKQKGTIVKVVEDFKVIAPHILINQRFFDNGQELTLGSATYKHNEQELILDKTAVKLLNGALPLTQSEELAEQVYDEILDQVMHYFPLYDTNQFRAKLSAGKAAFMKLPWKSIWDGNKMTQIGQQIILDRILIGLHANAAVSDLGVLKISTPLGKMQQPSGISLSPDTQIIYQSPTGLFERRVALRDL

SEQ ID NO: 1000 - protein, 1368 aa, Artificial Sequence
  Cas9
MVEKKSYSIGLDIGTNSVGWAVITDDYKVPAKKMKVLGNTSRQSIKKNMIGALLFDEGGPAASTRVKRTTRRRYTRRKNRLCYLRDIFESEMHTIDKHFFLRLEDSFLHKSDKRYEAHPIFGTLQEEKAYHDNYPTIYHLRKALADNTEKADLRLIYLALAHIIKFRGHFLIEGALSANNTDVQQLVHALVDAYNIMFEEDQLDIEAIDVKAILTEKISKTRRLENLISNIPGQKKNGLFGNLIALSLGLTPNFKSHFNLPEDAKLQLAKDTYDEELNNLLTQIGDEYADLFLSAKNLSDAILLSDILTVNGDGTQAPLSASLIKRYEEHRQDLALLKQMFKEQLPDLYRDVFTDENKDGYAGYISGKTSQEAFYKYIKPILETLDGAEDFLTKINREDFLRKQRTFDNGSIPHQIHLGELQAILERQQAYYPFLKDNQEKIEKILTFRIPYYIGPLARGNSRFAWLTRTSDQKITPWNFDEMVDQEASAQAFIERMTNFDEYLPQEKVLPKHSLTYEYFTVYNELTKVKYVTEGMTKPEFLSAGQKEQIVELLFKKYRKVTVKQLKEDFFSKIECFDTVDISGVEDKFNASLGTYHDLLKIIKDKAFLDNSENENIIEDIILTLTLFEDKEMIANRLAVYEDLFDQNVLKQLKRRHYTGWGRLSKQLINGMRDKHTGKTILDFLKADGFINRNFMQLINDDNLSFKEEIKKAQEGGLKDSINDQIRDLAGSPAIKKGILQTINIVDEIVKIMGKAPQHIVVEMARDVQKTDIGVKQSRERMKRVQEVLKKLGSQLLKEHPVENFQLQNERLYLYYLQNGKDMYTGEELSISNLSHYDIDHIIPRSFIKDDSIDNKVLTRSEHNRGKTDNVPSIEVVKRMKPYWQKLLDTKVISQRKFDNLTKAERGGLQESDKANFIQRQLVETRQITKHVAQILDSRFNTERDEKDRPIRRVKVITLKSKFVSDFRQDFGFYKLREINDYHHAHDAYLNAVVGTALLKMYPKLASEFVYGDYQKYDLKRMVGKSGKASGHATAKYFFYSNLMNFFKSEVKLANGNIIKRSPIEVNEETGEIVWDKTKDFGTVRKVLSAPQVNIVKKTEIQTGGFSNETILSKGKSSKLIPRKNKWRDTTKYGGFNTPTVAYSVLVVAKVEKGKAKKLKPVKELVGITIMERTKFEANPIAFLESKGYHDIQEHLMITLPKYSLFELENGRRRLLASATELQKGNEMVLPQHLVTFLYRVSKRDKGTQSENMEYISNHKEKFIEIFHYIIRYAEKNVIKPKVIERLNDTFNQKFNDSDLTELSISFLNLFKFTSFGAPEKFTFLNSEIKQDDVRYRSTKECLNSTLIHQSVTGLYETRIDLSQFGGD

SEQ ID NO: 1001 - protein, 1368 aa, Artificial Sequence
  Cas9
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 1002 - protein, 1368 aa, Artificial Sequence
  Cas9
MDKKYSIGLDIGTSSIGFVGVDENGWPLNIKGKRAIGAHLFREGEAAAETRGFRTTRRRYNRRKWRLRLLREIFDEPISRVDPTFFARMKESSVSPKDPNYDGLAKEILIPRDKDGKILYPTIYHLRHALMYEDHQFDIREIYLAIHHIVKYRGHFLLDGAAKNFESSNLDLKSDIHEINAILVGIFGNEQVQFNDQYVEKLKEVLLDSTQSRSDRQKAAAKLLLPTNDLDKDTTKILKTVSTEITKAITGLKAKFFVITGNDIAKDQQKDWTFSIDTLDEKMSVIEPSFSEKNFSLITILQKLYSSVTLAGIVPNGLSLSEAMIQKYDRHASDLVLLKKYWDTKPKVLKHQLQNTYAEYIEIHQVVDEFYSDLSKLIKNDDDTLAQEIKSKITIGNFLPKQRTTENGVIPYQLQQRELDTIIKNQQEYYPWLAEENPVADHQIAFPYKLDELVGFRIPYYVGPMIAKEDTSNSKNSKFAWMIRKQSGEVTPWNFDEKIDRTASATAFIDRMTTTDTYLIGEDVLPKQSLIYQRFEVLNELNKISIDGQPITRKQKQSVYTHVFEKKKTVQVKDVQKFLVSSGEVMSLPKIGGLANEKQFNSSLSTLYDYNKIIPDALEDRNKVDDIEKIILWSTIFEDNSIFVEKLDSIDWLTSSQRKRLAQKRYRGWGRLSLRLLTTFKNKDGYSILDELWNSNHNFMEIQAQSDFSEQIATANNNNLSQVLPAKWEPGRKNLASLDEFISNLYTSPQNKKALRKAIRVVQDMMTAAGHMPEKIFIEVARDTSNSHQQTIARQRQLQQLYQSEDKEVIDSSVRSELDDILKNRANIKDQLFLYFQQGGRDLYTGKAINIDKLSLYHIDHILPQSLVKDDSLDNRVLVSQKTNEDKGVTFVSDKYMNNMLPTWKRWHEMGLISARKLKNLTMRPDEIDKYAPGFIQRQLVETRQVTKLVIELLDALLGNSQTEIITIKASLSHQFRQQFDLVKIREVNDNHHAFDAFLAARIGTYLYKRYPKLRPYFVYGQYMQNHKNLKSINLIKTLDSDKAIVDEGTGEILWDKKSDLAKMIKIYNYQRLLITHESRTSFGAMYKQKILKATDAKQNGGGFKLVPTKRNRPVDIYGGYTGQTAAYLTIVRVYSKKTSELRVLPIYTNKVQQIEKAMTQGDKATMLAFKKVIAPQLGKENKKTHEIKIPEFDVVIPKVLLDQLVIDDIAGSPHRFRLGTDTYYHNSQQLFLPLSMQRQLMDRESDDKVYLDIFNDVLKQVDSYFNLYDVNGFRAALQKSKKAFEQLPINDFPKDVPDNKKKKGKRSILKEIFIGLHANATLGNLKQMGIKTDFGKLQKSNGLRITENCKIIHQSPTGLFERIVPIK

SEQ ID NO: 1003 - protein, 1368 aa, Artificial Sequence
  Cas9
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 1004 - protein, 1368 aa, Artificial Sequence
  Cas9
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 1005 - protein, 1368 aa, Artificial Sequence
  Cas9
MSRPYNIGLDIGTSSIGWSVVDDQSKLVSVRGKYGYGVRLYDEGQTAAERRSFRTTRRRLKRRKWRLGLLREIFEPYITPIDDTFFLRQKQSNLSPKDQRKLYTQTSLFNDRTDRAFYDDYPTIYHLRYRLMTEKRQFDIREIYLAMHHIVKYRGHFLNEAPVSSFKSSEINLVAHFDRLNTIFADLFSESGFQLETDKLAEVKALLLDNQQSASNRQRQALSLIYTPSTNKAVEKQNKAIATELLKAILGLKAKFNVLTGIEAEDVKAWTLTFNAENFDEEMVKLESSLDDNAHQIIESLQELYSGVLLAGIVPENQSLSQAMITKYDDHQKHLKMLKAVREALAPGDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQRQSSDAKFAWLIRKAEGRITPWNFDDKVDRQASANEFIKRMTTTDTYLLAEDVLPKQSLIYQRFEVLNELNGLKIDDQPITTELKQAIFTDLFMQKISVTVKNIQDYLVSEKRYASRPAITGLSDENKFNSRLSTYHDLKMIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNSRLSVQRKRQVEQVYQNISNELLNNTEIRNELKDLSNSALSNTRLFLYFMQGGRDMYTGDSLNIDRLSTYDIDHILPQSFIKDNSLDNRVLVSQKMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWDKESGLAYLNKIYQFKKILVTRGVHENSGALFNQTLYAAKDDKASGQGGKQLIPAKQDRSTALYGGYSGKTVAYMCIVRIKNKKGDLYKVCGVETSWLAQLKQLTDEDSQKAFLEQKISPQFTKVKKQKGNIIEAVEEFEVIAPHILINQRFFDNGQELTLGSATYKHNEQELILDKTAVKLLNGALPLTQSEELAEQVYDEILDQVMHYFPLYDTNQFRAKLSTGKAAFMKLPWKSQWDGNKMVQVGQQVILDRILIGLHANAAMSDLKVLKMTTPFGMIQQSTGITLSADTQIIYQSPTGLFERRVALRDL

SEQ ID NO: 1006 - protein, 1368 aa, Artificial Sequence
  Cas9
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1007 - protein, 1369 aa, Artificial Sequence
  Cas9
MKRILGLDLGTNSIGWALVNEAETVNEKSSIVKLGVRVNPLTVDEQKNFEAGKSIPTNAGRTLKRGMRRNLQRYKLRRDYLIQCLKEYGWITSDTLLYECGNRTTFETYRLRAKAVDEEIALEELGRVLLMINKKRGYKSNRKAKSSDEGQLIDGMAIAMDMYHNGTTPGEYVYSLLSKGKKYIPVFYRSDLLDEFDRIWDYQCAYYPDILTSQFKELIRGKSSQVTSKLFKQQYNLFTADNKEKDKRLQAYCRRADALKKRLPVEEVAAALCDVNRDVNASSGYLGTISDRSKKLFFNKQTVGQYLMLELDKDSHFSVKNEVFYRQDYLNEFEAIWEKQAEYHPELTPDRKKILRDVVIFYQRPLKSQKDLVACCELERRRIEVMKDGKVRSVEIGPKVCPKSSPLFQDFKIWHVLNNLKVRDKATGDERFLELDEKEILFSELAIKSKLSKTEALKLLYQKPKGLDLNYDSVEGNTTQAALFEAYQTVIAMTGHGEYVFSKMSASEVMSVVEGVFGGLGFNTSVLRFDSLLQGKELEKQDSYRLWHLLYSYEGDNSVTGTDGLVAKVASLLRCDEEYAKVVAGVTFQPDYGSLSAKAIRRILPHMRAGNEYSLACEYAGYKHSRRSLTKEELEQKDYKDHLELLPRNSLRNPVVEKILNQMVNVVNAVVDAYGKPDEIRIEMARELKKSAKEREEMTAAINKATSEHERIKEILNKEFGIQHVSHNDIVRYKLYCELKNNGYKTLYSDTYIPQEKLFSKEVDIEHILPQARLFDDSFSNKTLEYRSVNIEKSNQTAWDYVAAKWGEEGSLRYKKRVDDLLAAGVIGKSKHDKLLMKQEDIPTDFINRDLRDTQYIARKAREILEDLVPMVVSTTGAVTDRLREDWQLVDVMQELNWDKYAMKGLTEEWTDKDGRRISRIKEWTKRNDHRHHAMDALTIAFTKHSFIQYLNNLNARSDKSGSIYAIEQKELYRDNHGKLRFIMPFEGFRSEAKRQLENILVSIKAKNKVVTRNVNNARRGSGRQAKVQLTPRGQLHNETIYGSIHRYVTKLEKVGGNFDGEQIAKVANLRYREALQARHEAFGGDAKKAFTGKNALDKNPLYLKDTRTEVPLKVKTVSTETLYTIRKAVAPDLNVDKVIDAKVRKVLEERLQEYGGDPKKAFVNLDENPIYLNKAKGITIKRVAITGVNNAIALHDKKDVGGHVMLDASGRKQPVDFVNTGNNHHVAIYRDAEGSLQEVVVSFYEAVARVSLGLPVIDREYRKEDGWQFLFTMKQNEYFVFPNPETGFNPQEVDLTDETNYALISPNLFRVQKFTIKDYFFRHHLETTVEDRKELKDMTWKRCGLGGIIGIVKVRVNHIGRIVSVGEY

SEQ ID NO: 1008 - protein, 1369 aa, Artificial Sequence
  Cas9
MAKTYNIGLDIGTNSIGWAVVDDQNHLMSIKGKYGYGVRLYDEGKTAEERRSFRTTRRRLKRRKWRLSLLREIFEPQITPLDNTFFLRQKQSSLSSKDNRKLYPEMSLFNDRTDTDFYTQYPTIYHLSRDLMTKNKQFDIREIYLAMYHIVKYRGHFLNESPVSSFKSSEIKLAENFETLNQIFNERFNESMFQLAVNDFDDLKALLLNDQQSASNRQKKALGMIYVPNENKSLEKQNKAIATELLKAILGLKAKFNVLTGIEVDDAKPWTLSFNSESFDEDIDKAATNIDDDSREIIAILQGLYSGILLAGIIPENQSLSEAMVEKYDQHAAHLKQLKSIYPLLSISDKKAIQQAYNYYIDGQDNAKAYSREDFYAATTKALKSYQDNETIAEILKLIELEQFMPKQRTKDNGAIPHQLHQQELERIIENQQKYYPWLAELNPNESRRKIAKYKLDELVAFRVPYYVGPLITSEQQQQSSNKKFAWMIRKAEGKITPWNFDEKVDRQASANEFIKRMTTTDTYLLAEDVLPKQSLVYQRFEVLNELNGIKIDDVPITVEQKQRIFNDLFMMQASVSVKNIQDYLVSKGYFASRPEITGLSDENKVISRLSTYHDLKAILGGIVDEANKQADLEKCVEWSTIFEDGKIFVEKLNEIEWLTDEQRKRLSSKRYRGWGRLSNKLLNQIVNENGQRIMDLLWDTTDNFMRIVHSEEFDKLISAANQTLLSKNDVQDVINDLYTSPQNKKALRQILLVVSDIQKAMKNQAPSKILIEFAREDEANPRLSVQRKRQVEQVYQNISKDILSDSDVKAELKDLTNTALANTRLFLYFMQGGHDMYTGETLNIDRLSEYDIDHILPQAFIKDNSLDNRVLVSAKMNRSKSDQVPLNDYTEERFGSKMRVQWEQMLRAGLITKRKYDNLTLNPDRISKYAMKGFINRQLVETRQVIKLVTNLLMDHYEDDEVQLITVKSGLIHQMREMFDFPKNRNLNNHHHAFDAYLTAFVGIYLLKRYPKLTPFFVYGSYQKNNTNDKWRNFNFLNDLKKEEVIDSDSHEVIWNKAQGLVELDKIYQFKKILVTREVHENTGALYNQTLYSAKDDKASGQGGKQLIPAKQDRPTALYGGYSGKTVAYMCIVRIKSKKEDTYKVCGVKTSWVAELERLSDSNEQLASLKAKLMPKFTKNKKQKGKTIQVTEDFEIIVPRVLINQRFYDNGQEITLGSATYKHNEQELMLNKKAVKLLNGQLSLVEAETLAPQVYDEILKQVMKYFPLYDTNQFRTKLKMGKEQFIKLPWKNKWDGNKLIHVGQQTVLDRILIGLHANAAVSDLSTLKVTTPFGKLQQPSGIALSLNTKIIYQSPTGLFERRVALRGL

SEQ ID NO: 1009 - protein, 1369 aa, Artificial Sequence
  Cas9
MDKPYNIGLDIGSHSIGWTVVDDNSKLVRIKGKLGYGVRLFDEGKTAEERRQFRTTRRRLKRRKWRLRLLREIFEPHIAPLDETFFLRQKQSNLVPTQKKLPQLSLFNDRSDAEFYHKYPTIYHLRNALMTEKRQFDLREIYLAIHHIVKYRGHFLNAAPAASFKSGKFDLENKFDQLNLLFASAYSDLDFTLRTDNVDQVKAILLNEDLSASTRQRQALPLIYQTSADQKAAKKLTKSLATELLKAILGLKAKFDVLTGIETDDTKAWRLTFNAEDFDDKLNELNVTDNEAATQIIEILRELYSSILLAAIVPENYTLSQAMMAKYNAHKQHLSLLRQVKTTLPAKKQKELQAAYDDYIDQHLPLDKFYAKLTKVLPKEKDTDNPQIIQILNLIDLDQFLPKQRTKDNGAIPHQLHQQELDQIIDNQKAYYPWLAQLNPNEKRQKIAKYKLDELVAFRVPYYVGPLIEAKTQQKTSGANFAWMIRKEPGTTTPITPWNFDEKVNRQASANEFIKRMTTTDTYLLGEDVLPKHSLLYQRFEVLNELNGIKIDQKRVTVRQKQAIFNDLFLKQPNVTVKKLQQYLQAKGEYASAPIITGLSDPKKFNSQLSTYHEYKKIFGGLIDDPDKQADFEKCIEWSTIFEDSQILKDKLKEINWLTPEQRHKVANKRYQGWGRLSKKLLTQLVDYNGQRIIDILWNTTDNFMQIVHSEAFDKAIIKENQALLTQYNPQAVIDDLYTSPQNKKALRQILLVVNDIQKALKGQAPSRILIEFAREGQENPRLSTQRKQQVENAYKEASDALLSSAEVRQELKGLDNKALANTRLFLYFMQGGRDIYTGKSLNIDDLSKYDIDHILPQAFIKDNSLDNRVLVSAKMNRSKSDQVPLNDFAEIRYGKQMRQQWEKMLRAGLITRKKYHNLTLNPESINKYTAKGFINRQLVETRQVTKLATNLLVDQYAEDDVQLITVKSNLTHQMREEFDFPKNRNVNNHHHAFDAYLTAFVGLYLLKRYPKLAPYFVYGDYQKGASQNSKWRNFNFLGNLHREKVVDKNTGEIIWQRDAGLGELNRIYNFKKILVTRALRVNRGPMFKQTIYKAEEDKSSGRGSKQLIPTKKNRPTELYGGYTNKETAYLCLVKEPHKKGDIYRICSVLNMWLTELDRIADPIAKAQKLTELLTPQFTTTKKKQGQKIPVVKPFKVVIPKILINQRFFSRGQELTVASPMYMHNEQELFLNKKTIKLLNGQLAKNEAHELAPKIYQQILDQVNDYFPLYDMYKFRDTLNASKEIFVNLPWQDQRQDKKISQSGQKSILNKILIGLHANAARIKLTELNFKSDFGLLSQRSGIAFSPDDQIIYQSPTGLFERRVTLKDL

SEQ ID NO: 1010 - protein, 1369 aa, Artificial Sequence
  Cas9
MKVNNYHIGLDIGTSSIGWVAMGEDGKPLRVKGKTAIGARLFREGNPAADRRMFRTTRRRLNRRKWRLKLLDEIFDPYITPVDSTFFARLKQSNWSPKDSRKAFKDSTLFPDLTDKQYHLDYPTIYHLRHALMTQDKQFDIRMVYLALHHIVKYRGNFLNSTPVDSFKASKVNFDDQFKKLNELYTAINPEESFQINFANSEKIGQQFLDPSIRKFDKKKQISKIVPVTMDDKAVDKLNGKIASEIVNAILGYKSKLDVAVQCDPEDSKPWAVKFDDEDIDAKLQKILPEMDENQQSIIGIIQDLYSQVTLNQIVPNGMSLSESMIKKYNDHHDHLKLYKKLIGQISDSKKKTALKKAYDQYVGNDGKVIEQDDFYSSVKKNLDDSELSKQIMDLIDADKFMPKQRTSQNGVIPHQLHQRELDEIIEHQSKYYPWLAESNPNKHDLHLAKYKIEELVAFRIPYYVGPMITPEDQKKSGAAVFSWMKRKEPGQITPWNFDQKVDRMESANKFIKRMTTKDTYLIGEDVLPDESLLYEKFKVLNELNMVRVNGDSLKVADKQAIYQDLFENYKHISVKKMQNYIKDKTGLPNNPDISGLSDPDHFNNSLGTYNDFKKLFGDKVDDPDLQDDFEKIVEWSTVFEDKKILRAKLNEISWLSDKQKDDLESSRYQRWGRLSKKLLTGIVNDQGERIIDELWNTNKNFMQIQSDDDFAKRIHEANADQMKATDVEDVLADAYTSPQNKKAIRQVVKVVDDIQRAMGGVAPKFISIEFTRSEDRNPRRTISRERQLEDTLKDTAKTLVKSMNPDILSELDNASKSKKGLTDRLYLYFTQLGRDMYTGKPINIDEISNYDIDHILPQAFIKDDSLSNRVLVSKAVNNGKSANVPLKLFGVKMAHFWKQLAEAGLINKRKLKNLQTNPDTISKFAMHGFIRRQLVETSQVIKLVANILGDKYRNDDTKIIEITARMNHQMRDEFAFIKNREINDYHHAFDAYLTAFLGRYLYHRYIKLRPYFVYGDFKKFREDKVTMRNFNFLHDLTDDTQARIADTETGEVIWDRETSIKQLRDVYHYKFMLISQEVYTLRGAMFNQTIYPADEAGRKKLIPTKADKAVDVYGGYSGSNDAYMAIVRIHDKKGDKYKVVGVPMRALDRLNAAKNVSDAKYDQVLKDVLTPQFTKSKKSRKTGEISQTVEDFEVVLGKVMYRQLVIDGDKKFMLGSSTYQYNAKQLVLSDESVKTLASKGKLDEAQESAAYDNVYDEILDKVDRYFALYDQRNYRTNLHEGEQKFIGLPLHDTFDGSKKVANGKRETISDILNGLHANATMTNLKVLGISSPFGMFQSHGPINLNPETIILCQSPTGLFERRIILRDL

SEQ ID NO: 1011 - protein, 1370 aa, Artificial Sequence
  Cas9
MKKRNYNIGLDIGTSSIGWTIVDDNAQIMRAKGKNGYGVRIFAEGKTAADRRGFRTTRRRLKRRKWRLRLLQEFFEPYILPIDENFFMRQKESNLVPQDPNKHFKGSILFNDRTDQEFHEQYPTIYHLRYALMTEHRQFDVREIYWAIHHIVKYRGHFLNSTLASKFKGGELRLADKFESLNKLFLRVQAETGFELSEDNVDKIKTVLLDNGKSRLDRQREVLKIVYLTSEDKDTEKKRKAVATEFIKAVLGLKTKLFIVLAKNPTAETDWKFSFDAEDIDDKLDSISEQLTDDDHEIVELISEIHSIITLTGVVPEGMGLSESMIAKYDQHQLDLKKLKSLMRDLDVKQARKLQDAYDEYIDGLKPSEEAFYSAVSSVIQKMDDPRAKKITAEIELEEFMPKQRTKANGQIPHQLHQQELDQIIENQKEYYPWLAEENPNKREHNAAPHKLDGLVTFRVPYYVGPLIEASVQQKTSNSNFAWMERKVKNDTSRITPWNFEEKVDRNASAENFIKRMTTKDTYLLNEDVLPQQSLLYQRYEVLNELNNVRVNDKKLENNCKQDVYKDLFKNNTTVSIKKFKDYLVANCEYADNPKIEGLADESIFLSSLSTENKFKDIFGAQIDDPNYFEDFEHIIEWATIFEDNKILRAKLDEISWLNESQKKELAKLRMRGWGRLSRKLIAEITDENGSRIIDLLWEHMDNFMVVVNQDVFKEKIVAENKQVFKELNPLDIINEQFTSPQNKKALRQILLVVADIQKAMNGVTPSNIFIEFAREDERNPRRSIQRLRQVENMYRDISDTVLADPEVRNELSNIKNTELARDRVFLYFLQGGRDVYTGEPLNIDKLSEYDIDHILPQAFIKDNSLDNRVLVSASLNRSKSDSVPLDDFTSEMFGRKMEPLWEQMQRAGLISKKKLANLKFNPENINKYTRNGFINRQLVETRQVIKLAANILKDHYGEETEIVNVKAGLTHQFRKDFDFPKNRNVNNYHHAFDAYLTALVGTYLLKKYPKLESYFVYGKFKKGDGITNLKNFNFLHGFNKPGKIINKETGEILFDRDKQLGYMNSIYDLRKVIVTHELSTRHGAMYDQTLYKASDDKDSGRGGKQLIRKKDNLPTEIYGGYTGSTDAFMSIIRMKKKDKLYYKVIGVPTRVAHEVLQSDGKINIFTLNKFIEQKLTKEKVNKKTGAITRITDWFELVIAKVMYGQVIDDGGQPFMLGSSTLPYNVRELYLAKDLVKVINKGSTSKSSYLDVYDELVKSLNKYFPMYDRNMFRQKITDARDKFEKLPKRDKVSNGKLQQIGQVTIIDRILIGLHTNAGVSNLKDLGIATPFGFMQQGNGISLTSTAKIIYQSSTGLFEKSKALDDLNPLA

SEQ ID NO: 1012 - protein, 1370 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDLIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 1013 - protein, 1370 aa, Artificial Sequence
  Cas9
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 1014 - protein, 1370 aa, Artificial Sequence
  Cas9
MKNANKVTGKYYLGFDIGTNSVGWAVTDENYNLCKFKKKSMWGIRLFEDAKTAEERRGQRASRRRLQRRKQRIDLLQEIFAEEINKVDETFFIRLNESRLHLDDKTVSEKHPLFIGSEYSEKEYYREYPTIFHLRKELMESSEPHDIRLVYLAIHHILKNRGHFLIDGELSKANSFDAAFYQMKEVLCNELDLEIDGENTTEVERTLRDRNISKSDKVKLLAALLAMNQNETESKETKKKIENICKLLAGNKGDISKIFGQTPEGVEKTSFSFGEADYDESIRPNLEESIPDQCFVIDSIKALYDWNVLADILNGQTYLSCAKVNQYETHKNNLKELKLLVNRYCSREEYKRFFKSAVEKANYSNYIGSAKQGNKIIDVKRCAEEDFYKELKILLSKIEPEEADRELYERIKREAEEGSLLPLQRNKDNSVVPNQMHKAELALILENAGSYLGFLNEKDEDGLSPAEKIIELFSFRIPYYVGPLSDRHKDRGSNAWIVRKAEGRILPWNFDEKVDREKSNEAFIERMTNKCTYLLGKDVVAKNSLIYSHFMVLNELNNLSVCGNKISVQVKQDIYRELFQRHTKVSKKMLLQYCREKMMNKDLEEEDLSGFDGDFKAKLSSYLDFEKKVFGAKMEEDRIRKITEDIIRWKTIYGDDGKMLQAVVEKEYPGELDSDQLKAVKQFRYSGWGNFSEEFLNGIVGTEKPTGQMFTIIEALWQTNCNLMQLLSKNFTFMEEIEKHNRELAGQITDISYDKLVKDLYISPANKRAVWQTVRIAEEVKKIMGCEPAKIFVEMARGGEKEKKRTISRKKKLLELYAACKKDARDWNREIEDRDEREFNSDKLYLYYTQMGRCMYSGERIDLHELMSANSKWDIDHIYPQSKVKDDSLDNRVLSLKKINNEKGNKPLSRDIQQSQQKWWTELLQLEFITKKKYDRLMHRGELSEEELSGFINRQLVETRQSTKAAAELLGRMYNNSKVVYVKAPLVSQFRKDDLNILKSRLANDYHHAKDAYLNIAVGNVYNEKFTDNPLRWIEKHAGENYSINRVFDYDIVAGDGAPVWAAPLRDEKNKLRKNEVGEKYGGTIDVIRKTVKRNDVLYTEHTYCGKGELFNATIAKKDGGAEIPLKAGLQTGKYGGYKSPNTSYFAAIEFDGKKGERVKNIMEVPVYIANILLHDIDAYIRYCETVKGLKNVKILRPCIKKNALISVDGYPMRIRGANEKNILLKNNLQPIFGRHEETVRRIEKYVEKNQEFEVDEKFDGLNEANLTDLYDDITEKLCGPYVERPSNQGEYLMENREKFLNISLKEKAKLLAQMIKLVRCDTETKADLRSIGASKNAGVISVNKNTLGGKRLILINQSVTGLFENRIEL

SEQ ID NO: 1015 - protein, 1370 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 1016 - protein, 1370 aa, Artificial Sequence
  Cas9
MTKIKDDYIVGLDIGTDSCGWVAMNSNNDILKLQGKTAIGSRLFEGGKSAAERRLFRTTHRRIKRRRWRLKLLEEFFDPYMAEVDPYFFARLKESGLSPLDKRKTVSSIVFPTSAEDKKFYDDYPTIYHLRYKLMTEDEKFDLREVYLAIHHIIKYRGNFLYNTSVKDFKASKIDVKSSIEKLNELYENLGLDLNVEFNISNTAEIEKVLKDKQIFKRDKVKKIAELFAIKTDNKEQSKRIKDISKQVANAVLGYKTRFDTIALKEISKDELSDWNFKLSDIDADSKFEALMGNLDENEQAILLTIKELFNEVTLNGIVEDGNTLSESMINKYNDHRDDLKLLKEVIENHIDRKKAKELALAYDLYVNNRHGRLLQAKKKLGKIKPRSKEDFYKVVNKNLDDSRASKEIKKKIELDSFMPKQRTNANGVIPYQLQQLELDKIIENQSKYYPFLKEINPVSSHLKEAPYKLDELIRFRVPYYVGPLISPNESTKDIQTKKNQNFAWMIRKEEGRITPWNFDQKVDRIESANKFIKRMTTKDTYLFGEDVLPANSLLYQKFTVLNELNNIRINGKRISVDLKQEIYENLFKKHTTVTVKKLENYLKENHNLVKVEIKGLADEKKFNSGLTTYNRFKNLNIFDNQIDDLKYRNDFEKIIEWSTIFEDKSIYKEKLRSIDWLNEKQINALSNIRLQGWGRLSKKLLAQLHDHNGQTIIEQLWDSQNNFMQIVTQADFKDAIAKANQNLLVATSVEDILNNAYTSPANKKAIRQVIKVVDDIVKAASGKVPKQIAIEFTRDADENPKRSQTRGSKLQKVYKDLSTELASKTIAEELNEAIKDKKLVQDKYYLYFMQLGRDAYTGEPINIDEIQKYDIDHILPQSFIKDDALDNRVLVSRAVNNGKSDNVPVKLFGNEMAANLGMTIRKMWEEWKNIGLISKTKYNNLLTDPDHINKYKSAGFIRRQLVETSQIIKLVSTILQSRYPNTEIITVKAKYNHYLREKFDLYKSREVNDYHHAIDAYLSAICGNLLYQNYPNLRPFFVYGQYKKFSSDPDKEKEIFNKTRKFSFISQILKNKSENSKEIAEKLKRAYQFKYMLVSRETETKDQEMFKMTVFPRETPGNLIPKKKGMAPEIYGGYTKNSDAYMVIVKIDKKKETEYRILGIPTRELVNLKKAEKEDHYESYLKEILAPRILYNKNGKRDKKITSFEIVKSKIPYKQVIQDGDKKFMLGSSTYVYNAKQLTLSTESMKAITNNFDKDSDENDALIKAYDEILDKVDKYLPLFDINAFRKKLHSGREKFVELSLEDKKDIILKVLIGLHDNPATSDLKTLGFSSTELGKMQKNSGIVLSGNAKLIYQSPTGLFKKSVKISDL

SEQ ID NO: 1017 - protein, 1370 aa, Artificial Sequence
  Cas9
MTKIKDDYIVGLDIGTDSCGWVAMNSDNDILKLQGKTAIGSHLFEAGKSAADRRLFRTTHRRIKRRRWRLKLLEEFFDPYMAKVDPYFFARLKESGLSPLDKRKNVFSIVFPTAAEDKKFYDDYPTIYHLRYKLMTEDEKFDLREVYLAIHHIIKYRGNFLYNTSVKDFKASKIDVKSSIEKLNELYENLGLDLNVEFNISNTAEIEKVLKDKQIFKRDKVKKIAELFAIKTDNKEQSKRIKDISKQVANAVLGYKTRFDTIALKEVSKDELSDWNFKLSDIDADSKFEALMGNLDENEQAILLTIKELFNAVTLNGIVEDGNTLSESMINKYNDHRDDLKLLKEVIENHIDRKKAVKLALAYDLYVNNRHGQLIQAKKKLGKIKPGSKEDFYKVVNKNLDDSQASKEIKKKIELDSFMPKQRTNANGVIPYQLHQLELDKIIENQSKYYPFLKEINPVSSHLKEAPYKLDELIRFRVPYYVGPLISPNESTKDIQTKKNQNFAWMIRKEEGRITPWNFDQKVDRIESANKFIKRMTTKDTYLFGENVLPANSLLYQKFTVLNELNNIRINGKRISVDLKQEIYENLFKKHTTVTVKKLENYLKQNHNLVKVEIKGLADEKKFNSGLTTYNRFKNLNIFDNQIDDLKYRKDFEKIIEWSTIFEDKSIYKEKLRSIDWLNEKQINALSNIRLQGWGRLSKKLLAQLHDHNGQTIIEQLWDSQNNFMQIVTQADFKDAIAKANQNLLVATSVEDILNDAYTSPANKKAIRQVIKVVDDIVKAASGKVPKQIAIEFTRDADDNPKRSQTRGSKLQKVYKDLSTELASKAIAEELNEAIKDKKLVQDKYYLYFMQLGRDAYTGEPINIDEIQKYDIDHILPQSFIKDDALDNRVLVSKAVNNDKSDNVPVKLFGNEMAGNLGITIRKMWEEWKNIGLISKTKYNNLLTDPDHINKYESAGFIRRQLVETSQIIKLVSTILQSRYPNTEIITVKAKYNHYLREKFDLYKSREVNDYHHAIDAYLSAICGNLLYQNYPNLRPFFVYGQYKKFSSDPDKEKEIFNKTRKFSFISQILKNKSENSKEIAEKLKRAYQFKYMLVSRETETKDQEMFKMTVFPRETPGNLIPKKKGMATEIYGGYTKNSDAYMVIVKIDKKKETEYRILGIPTRELVNLKKAEKEDHYESYLKEILAPRILYNKNGKRDKKITSFEIVKSKIPYKQVIQDGDKKFMLGSSTYVYNAKQLTLSTESMKAITNNFDKDSDENDALIKAYDEILDKVDKYLPLFDINAFRKKLHSGREKFVELSLEDKKDIILKVLIGLHDNPATSDLKTLGFSSTELGKMQKNSGIVLSGNAKLIYQSPTGLFKKSVKISDL

SEQ ID NO: 1018 - protein, 1370 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPKVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 1019 - protein, 1370 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 1020 - protein, 1370 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 1021 - protein, 1370 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPLLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLDIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 1022 - protein, 1370 aa, Artificial Sequence
  Cas9
MKKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPGLDSNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLKKYISRFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 1023 - protein, 1370 aa, Artificial Sequence
  Cas9
MKKPYSIGLDIGTNSVGWAVITDDYKVPAKKMKVLGNTDKNYIKKNLLGALLFDSGNTAEDRRLKRTARRRYTRRRNRLLYLQDIFSDEMNKVDESFFHRLEDSFLVSEDKRGDHHPIFGNVVDEVKYHEQFPTIYHLRKYLADTPEKADLRLVYLALAHMIKFRGHFLIDDPKLDVKNTDSQELFSQFLTAYDVTQEDSHLADVKINISDIITEKMNKSRKVEALLFHFPSQKKNSFFGNLVSLVFGLLPNFKTNFNLAEDAKLQLSKDSYDEDLENLLGQIGDEYTDVFVAARKLYDSILLSGILTVNDLSTKAILSASMVRRYEEHNKDLAKLKAFVKANFTHDVFKEVFSDASKNGYAGYIEGKTSQEDFYKYVKNLIGKVDGSADFIEKIDREDFLRKQRTFDNGSIPHQVHLAEMKAILRRQGEYYPFLKEHAEKIQQILTFRIPYYVGPLDRHGHSDFAWASFNSEEKVTPWNFEEIIDKNKSAQAFIERMTNQDLYLPNEKVLPKHSPLYEKYTVYNELTKIKYVTETGTAKFFDANLKQEIFDGLFKKERKVTKRKLLTFLEKNFDEFRIVDIQGLDKETETFNASYGIYQDLLKIIKDKAFMDDSENADILEDIVLTLTLFEDREMIKQRLAKYADLFDKKVIDNLARRRYTGWGRLSAKLLNGIRDKRSRKTIMDYLVDDGRSNRNLMQLITDDNLTFKDEIAKAQYSDNSDDLHQVVQDLAGSPAIKKGILQSVKIVDELVKVMGYEPEQIVVEMARENQTTAKGRRNSQQRYKRLEEAIKNLDRDLNYKILKEHPTDNQALQNDRLFLYYLQNGRDMYTGESLDINRLSDYDIDHIIPQAFIKDNSIDNRVLVSSAKNRGKSDDVPSEDVVNRMRPFWNKLLNCGLISQRKYSNLTKKELTPNDKAGFIKRQLVETRQITKHVARILDEHFNKEFDEDKKRIRKVKVVTLKSNLVSNFRKEFELYKVREINDYHHAHDAYLNAVVAKALLMKYPKLEPEFVYGEYPKYNSYRERKTATQRMFFYSNIMNMFKSKVKLADERIIERPMIEVNDETGEIAWDKTKHIATVKKVLSYPQINIVKKVEEQTGGLTNETIYPRGSFDKLLNRKNTLEASKYGGFGSPTVAYCVLVVADSKNENGKVKKLKLGSELLGITILEKNDFENNSLDFLSRKGYQGVQEKKIIKLPKYSLFEFQDGSRRMLSSVMANDNKRGDLQKANEMILPAYLVKLLYHAKHINSVGEPAHKNYINEHCSEFQDLLNYIRQFADKFVDVDKNLSKIRSLSKSMAEYSVSEICSSFVNLLTLTALGAPADFKFFGTTIPRKRYGSPQSILSATLIHQSITGLYETRIDLSKLGED

SEQ ID NO: 1024 - protein, 1370 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 1025 - protein, 1370 aa, Artificial Sequence
  Cas9
MEKNKEYVIGLDIGTGSVGWSAISTDNYQLIRQKGKNLIGVRLFNSAETAEERRGYRTTRRRLSRRRWRMSLLNDIFRPELNEIDENFLARLKYSWVSPLDQKNPQLNEQGTNASLYGDIEADQAFHRAYPTIYHLRKTLMEDNQKHDLREVYLAIHHIVKYRGHFLTPDFDANSQTIDIKGLFKQLGDVSGSIELQADQTSTVIAAFQSILLDFTKTPTESGRLAGQLFSDQNKDKQAKKQVEELFKLLRGGKGSLADMFLLTDLDKVVKNQLKFAFDDAVDENLNLISNLINEEQYELLLNIQKLRGTIILKQILGDDETVSDAKVRSYEEHAHQLKELKAQVLTKDNKEKFEEAYQLIQKGDASRIDGLKKLKTIINQEHEALRLDKYEADKLLKLIELDQLLPVQRSKRNGEIPHQLHEFELKKIIEKQGRYYPFLRETFERDGQEFNKIGQLVNFRIPYYVGPLVDPRLAGIQSGDQTNHWMTQKKAGKITPWNYTELIDIDKSAAEFIKRMTGTDTYLVGEPSLHKASLIYQDYNVLQELNNLRYDGKPLPVDAKQEIYSNLQVSLKNATKNKINSFLISEGYLQDGEELTGFAGKELKNKLSSFHYFKNIFGPERMNTLGTDNLEKITELQTVFEDRHMLKRQLQKLGFLDDDECEKLAGKHFTGWGNLSKKLLNTPAIIDPEINENKISLIDALYKGQRNLSFYVNNMDDKYQFRDWIESENQSQQVEISLDEKIKNLAGSPAIKRGITQSMAVIQDIIRANNGISPKRIYLEFARESQNSYQPNSRIKQIEKIYDQNKKELMKVYPDVFKDVQGVLNNVDENNSLSEKAFLYFMQLGKDMYTGEALDFDKLYTYDIDHIIPQAMTKDNSWDNKVLVTAIKNREKSNQVLDNAIQAKMHNFWLQLKKVNLLSQRKYDTLMKTNFSKGDEKKFIARSLVETRQIIKNVAELIKSEFDHVEAIPIRQELTSDMRQLMDYKKNRLVNDYHHAHDALLIATVGEFMQKRGFMQGMNPSQNVYHGYTQYVKKWLSMAKKARSAEKPERIFPLQFVVGSMRMAVRDGQVDKVTHPATGEICWTADNEAYLRKVLGYKNILVTRKVKNAGKLYQRVTVKPKGSGEAPVNHQKSDINIYGGVTSEQAAELVLIRIKAKNNAKNMVIKIPTAIANQVANKTTTYDAYVRSLNIPNYAGIILDQIPLGQLVFDERTSFYLASAEIKHNARQLWVNQHINNVLTKKNINDEERDNILNLLTNEKNLERFKLLEPDLKRVKAAKQQWASCDDQEQMQILRIIINKMHDDASPQIPGKIDPFKNYLDKQGKGWRDLRTKKGMKLSDNAEFVYQSPTGLYHRKISINELLKQKQLE

SEQ ID NO: 1026 - protein, 1370 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 1027 - protein, 1370 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDDLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 1028 - protein, 1370 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKERADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDDLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 1029 - protein, 1370 aa, Artificial Sequence
  Cas9
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 1030 - protein, 1370 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQHYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 1031 - protein, 1371 aa, Artificial Sequence
  Cas9
MKVNNYHIGLDIGTSSIGWVAIGEDGKPLRIKGKTAIGARLFQEGNPAADRRMFRTTRRRLSRRKWRLKLLEEIFDPYITPVDSTFFARLKQSNLSPKDSRKEFKGSMLFPDLTDMQYHKDYPTIYHLRHALMTQDEKFDIRMVYLAIHHIVKYRGNFLNSTPVDSFKASKVNFVDQFKKLNELYTAINPEESFQINLANSEDIGHQFLDPSIRKFDKKKQIPKIVPVSVDDKATDKINGKIASEIINAILGYKSKLDVVVQCTPVDSKSWALKFDEEDIDAKLQKILPEMDENQQSIIAILQNLYSQVTLNQIVPNGMSLSESMIEKYNDHHDHLKLYKKIIDQLADPKKKAALKKAYSQYVGDDGKVIEQADFWSSVKKNLDDSDLSKQIMDLIDAEKFMPKQRTSQNGVIPHQLHQRELDEIIEHQSKYYPWLAEINPNKHDLHLAKYKIEELVAFRVPYYVGPMITPDDQAKSAETVFSWMERKGKEAGQITPWNFDEKVDRNASANRFIKRMTTKDTYLIGEDVLPDESLLYEKFKVLNELNMVRVNGKLLKVADKQAIFQDLFENYKHISVKKLQNYIKSKTGLPSDPEISGLSDPEYFNNSLGTYNDFKKLFGNKVDEPDLQDDFEKIVEWSTVFEDKRILREKLNEITWLSDQQKDVLESSRYQGWGRLSKKLLTGIVNDQGERIIDELWNTNKNFMQIQSDNDFAKRIHEANADQMKAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGKPINIDEISTYDIDHILPQAFVKDDSLNNRVLVSKAINNGKSDNVPVQLFGAKMGHFWKQLAEAGLISKRKLKNLQTDPDTISKYAMHGFIRRQLVETSQVIKLVANILGDKYRNDNTKIIEITARMNHQMRDEFGFIKNREINDYHHAFDAYLTAFLGRYLYHRYIKLRPYFVYGDFKKFKEDKVTMRNFNFLHDLTDDTQEKIADAETGEVIWDRENSIQQLKDVYHYKFMLISHEVYTLRGAMFNQTVYPASDAGKRKLIPIKADRPINVYGGYSGSADAYMAIVRIHNKKGDKYRVVGVPMRARDRLDAAKKVSDADCDRALKDVLTPQLTKTKKSRKTGEITQVVEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVFDGNTKASSGKREILEEVLNGLHANPTFGNLKDIGITTPFGQLQQPNGILLSDEAKIRYQSPTGLFERTVSLKDL

SEQ ID NO: 1032 - protein, 1371 aa, Artificial Sequence
  Cas9
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 1033 - protein, 1371 aa, Artificial Sequence
  Cas9
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 1034 - protein, 1371 aa, Artificial Sequence
  Cas9
MNNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPGLDSTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLKRYISKSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 1035 - protein, 1371 aa, Artificial Sequence
  Cas9
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKELGSNILNEEKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDIRKFITSSGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 1036 - protein, 1371 aa, Artificial Sequence
  Cas9
MNLRNVESYQVGLDIGTGSVGWAVLDDNGDLCRFKGKPTWGSRVFPTAETAAEARVHRGQRRRYDRRRQRIDLLQRFFADEVAKVDPEFFIRLNQARLHPENRDPAHADYRWPLFNGSNFTEKDYYRQFPTIYHLRAHLLKSDEPADIRLVYLALHNIVKHRGNFLHQDNPSLSARNANVGDAVEALCLALDEWCGAHDVECACDEAALAEALGDASLRPGEKRERAEAALGVEKAHKKLAKAVSSAVVGYAAEFGHVFFAESEGSKFALSNDEKVEAYVCPDEGRDLFDAMRAVHSSYVLMGILSEAQGELLSVCKVGEYERYKRDLETLKSLVRAYGPERYDEFFCGPFYEGTRDYDPGKAQGYTKYNLGASKLSHEDFLKEVQKLLKDIGAQADERYADIERAIEAGAFLRRLKTSDNGTIPYQLHLEEMDAIIERQAAFYPFLAQEKDKLKSLVSFRIPYYVGPLTQKNAARDGKGEARFAWSSRKPGMEDARVYPWNWEDVIDKDQSAEDFIRRMTGTCTYLKGEPVLARCSLDYELFCVLNELAGARWTQDGDKSYRFDAADRLGIVEDLFKKRKRVTYEAAEKWLARTHGPESGKSAGGAYHVSGGQGEDAFESQLSSHYDFCKILGVDELSDADEAMAEDIILWNTVFEDRSILKRKIKLAYGDRLGDAQVRKLCQKRYTGWGRLSGELLRGLRSATDNGPKTIMDILLEGDPNHARRMGAAMNLMEILHDDLLEFQAKIDEHNRERALAVGGMSVDEVTGSPALRRGINQALRVVDEIAGIAGKPPAHIYVEVTRDEGARNKGRRTTSRYRALEAALSSIKAQCADVYAELKERDPRALDDERLTLYFMQCGKCMYSGDALDINKLQTYQVDHILPQSYVKDDSFENKVLVRPDTNQRKGDTLLLDERLIARMRGFWRTLRDAELIGEKKFNNLTRTSVSDEQMKKFVSRQLVETGQMVKQVQQLLQARYPESEVQPVKAGVSHQLRVGCALAKSREINDFHHAHDAYLACQVGRFVQYRHSAVYSEPVKMAAVVKQFIKKQAEDYRRTRELPGSDGFIVSSFMTPGFDVKTGEVFRDAWDAGAEIDRIRRCFDYKDCFISRMPEETHGAFWDATIYSPRAAGKTLSLPLKRGLDPRKYGSYSREQFAYFFVYEAVKPKKKQRVLEFAPVPVRVASALANDPDALEDYARELAEAEGLVFERIRRRKVYKYQQIIVGDSRLYVTGREEVRNARQLAFSQDETKLICRIEQGEECEEGELLDLFRSMQRKYLACAPRLARLMKVAEMEEGFIAATASGKREVLLSLTSIAAAHRNSIDLKPIGRKGSSGQMKITFSKELSTNGILFVDSSVTGMFERRCRLGL

SEQ ID NO: 1037 - protein, 1371 aa, Artificial Sequence
  Cas9
MENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASGLDSNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLKRYISRSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 1038 - protein, 1371 aa, Artificial Sequence
  Cas9
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 1039 - protein, 1371 aa, Artificial Sequence
  Cas9
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 1040 - protein, 1371 aa, Artificial Sequence
  Cas9
MENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASGLNSKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 1041 - protein, 1371 aa, Artificial Sequence
  Cas9
MKVNNYHIGLDIGTSSIGWVAIGEDGKPLRIKGKTAIGARLFQEGNPAADRRMFRTTRRRLSRRKWRLKLLEEIFDPYITPVDSTFFARLKQSNLSPKDSRKEFKGSMLFPDLTDMQYHKDYPTIYHLRHALMTQDEKFDIRMVYLAIHHIVKYRGNFLNSTPVDSFKASKVNFVDQFKKLNELYTAINPEESFQINLANSEDIGHQFLDPSIRKFDKKKQIPKIVPVSVDDKATDKINGKIASEIINAILGYKSKLDVVVQCTPVDSKSWALKFDEEDIDAKLQKILPEMDENQQSIIAILQNLYSQVTLNQIVPNGMSLSESMIEKYNDHHDHLKLYKKIIDQLADPKKKAALKKAYSQYVGDDGKVIEQADFWSSVKKNLDDSDLSKQIMDLIDAEKFMPKQRTSQNGVIPHQLHQRELDEIIEHQSKYYPWLAEINPNKHDLHLAKYKIEELVAFRVPYYVGPMITPDDQAKSAETVFSWMERKGKEAGQITPWNFDEKVDRNASANRFIKRMTTKDTYLIGEDVLPDESLLYEKFKVLNELNMVRVNGKLLKVADKQAIFQDLFENYKHISVKKLQNYIKSKTGLPSDPEISGLSDPEYFNNSLGTYNDFKKLFGNKVDEPDLQDDFEKIVEWSTVFEDKRILREKLNEITWLSDQQKDVLESSRYQGWGRLSKKLLTGIVNDQGERIIDELWNTNKNFMQIQSDNDFAKRIHEANADQMKAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLIDRLYLYFTQLGKDIYTGKPINIDEISTYDIDHILPQAFVKDDSLNNRVLVSKAINNGKSDNVPVQLFGAKMGHFWKQLAEAGLISKRKLKNLQTDPDTISKYAMHGFIRRQLVETSQVIKLVANILGDKYRNDDTKIIEITARMNHQMRDEFGFIKNREINDYHHAFDAYLTAFLGRYLYHRYIKLRPYFVYGDFKKFKEDKVTMRNFNFLHDLTDDTQEKIADAETGEVIWDRENSIQQLKDVYHYKFMLISHEVYTLRGAMFNQTVYPASDAGKRKLIPIKADRPINVYGGYSGSADAYMAIVRIHNKKGDKYRVVGVPMRARDRLDAAKKVSDADYDRALKDVLTPQLTKTKKSRKTGEITQVVEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVFDGNTKASSGKREILEEVLNGLHANPTFGNLKDIGITTPFGQLQQPNGILLSDEAKIRYQSPTGLFERTVSLKDL

SEQ ID NO: 1042 - protein, 1371 aa, Artificial Sequence
  Cas9
MKVNNYHIGLDIGTSSIGWVAIGKDGKPLRVKGKTAIGARLFQEGNPAADRRMFRTTRRRLSRRKWRLKLLEEIFDPYITPVDSTFFARLKQSNLSPKDSRKEFKGSMLFPDLTDMQYHKNYPTIYHLRHALMTQDKKFDIRMVYLAIHHIVKYRGNFLNSTPVDSFKASKVDFVDQFKKLNELYAAINPEESFKINLANSEDIGHQFLDPSIRKFDKKKQIPKIVPVMMNDKVTDRLNGKIASEIIHAILGYKAKLDVVLQCTPVDSKPWALKFDDEDIDAKLEKILPEMDENQQSIVAILQNLYSQVTLNQIVPNGMSLSESMIEKYNDHHDHLKLYKKLIDQLADPKKKAVLKKAYSQYVGDDGKVIEQAEFWSSVKKNLDDSELSKQIMDLIDAEKFMPKQRTSQNGVIPHQLHQRELDEIIEHQSKYYPWLVEINPNKHDLHLAKYKIEQLVAFRVPYYVGPMITPKDQAESAETVFSWMERKGTETGQITPWNFDEKVDRKASANRFIKRMTTKDTYLIGEDVLPDESLLYEKFKVLNELNMVRVNGKLLKVADKQAIFQDLFENYKHVSVKKLQNYIKAKTGLPSDPEISGLSDPEHFNNSLGTYNDFKKLFGSKVDEPDLQDDFEKIVEWSTVFEDKKILREKLNEITWLSDQQKDVLESSRYQGWGRLSKKLLTGIVNDQGERIIDKLWNTNKNFMQIQSDDDFAKRIHEANADQMQAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGEPINIDELNKYDIDHILPQAFIKDNSLDNRVLVLTAVNNGKSDNVPLRMFGAKMGHFWKQLAEAGLISKRKLKNLQTDPDTISKYAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQEKIADAETGEVIWDRENSIQQLKDVYHYKFMLISHEVYTLRGAMFNQTVYPASDAGKRKLIPVKADRPVNVYGGYSGSADAYMAIVRIHNKKGDKYRVVGVPMRALDRLDAAKNVSDADFDRALKDVLAPQLTKTKKSRKTGEITQVIEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVLDGNTKVSSGKREILQEILNGLHANPTFGNLKDVGITTPFGQLQQPNGILLSDETKIRYQSPTGLFERTVSLKDL

SEQ ID NO: 1043 - protein, 1371 aa, Artificial Sequence
  Cas9
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGSD

SEQ ID NO: 1044 - protein, 1372 aa, Artificial Sequence
  Cas9
MNNEYFVGFDIGTNSVGAAVTDEKYHVLKFKGNAMWTSAVFESAQQSADRRLNRTARRRLDRSQQRRDLLQELIAPAITPVDPRFFDRIRESALWAEDKTTGSRFTYFSDEGYTDKQYHKEYPTIHHLICSLMNDPAPHDPRLVYIACSYMLTHRGHFLNEADKEKIDDVLDIRRVFNELCSWFTSYGIEVPFSCPFEEFGNVLTANRGVQDRTRAFYDLLFAGKKPKPSEDDQVDIDVLIKLISGGKIELSKLFLNEEYSELENNKIQLSDAGFDEKEPELRSELGDDFGLVAAAKNIYDWSLLTGVLGECKSISEAKVKTYEKHSEDLAALRRVVRKYHPDKYKEIFKKYVVGNYTSYSGNVKSAGKISETKLKRCNQAEFCDYLKSKLKDVKPAPGDDECERVLKEISKHTFCPRQVTTDNRVIPYQLYYTELKKVLENAKRYIPQLNVTDEYGSAADKILSLMTFRIPYYVGPLVKKNDSSNAWIVRRGEGRILPWNFDELVDKDKCEDEFIRRMTCKCTYIAGKNVLPKNSLLYCKFMVLNEINNIKINGERISVGDKQKIYTELFEKKRKVTVRDIRNLLTSEGRLKAGDTFGGIDITVKSSLKPQHDLKRLMAAGVITEADAEEIIERITCTTDVSRLRTWLGKFGLSAADAKYVSGLKYSDFGRLSREFLTEVNDVDPATGEVINPNIITMMWENNINLMELLSQKYSYRSQIESMNREYYAANPLTLDERMSEMYIPSAVRRPVKRTIEMMKEYMHIMRKPPKRIFIEMARELTDLDNKGKRTSSRRNTLLEFFKKCPQDTTELRAQLEKKSDDELRSEKLYLYFAQLGKCMYSGESIDIERLGSKLYDVDHIFPQARVKDDSIENKVLVLSDLNGAKSDRYPINADIRNKMHSFWDKLHSIGLIGEKKYERLTRSTGFTDDELAGFISRQLVETRQSTKAVAALLAEEFPESEIVYVKAGLASQFRHEFGLLKCREINDLHHAKDAYLNIVMGNIYHVKFTKDPMNFVKEYRRKEQVFDLKIQSMLTHDAIRNGETAWIGDGTWLETVKKQMEKNNIRYVRYSFRRKGALFNLMPERKNPSLLPRKNGKNMVLPAEKYGGYNNTAASFFSLVKYHSAKGSGVVIIPVELIHAHRYEHDSSFAEEYALRVLADIVSLKKGDVLQSVEFPLGSRILKVNTLLDIDGFRANITGKDSGGKYLGISSASSLIISQVDTTYIKRVISINERISACEKNKQSYTIRPEFDVITSERNIEIYNMLCEKISSRPFCIKFANTSDTFVSGREKFIALSLNEQVKTLTNMLSVFKTGRASGCDLTNIGGSKNTAIVKLNAVLSNLKDFKSVRIIDQSPTGLYEKVSPNLLSL

SEQ ID NO: 1045 - protein, 1372 aa, Artificial Sequence
  Cas9
MTKKNYSIGLDIGTNSVGWAVITDDYKIPAKKMKVLGNTDKEYIKKNLLGALLFDSGETAEATRLKRTARRRYTRRKNRLRYLQEIFAEEIAKADNSFFQRLDESFLTDDDKDFDSHPIFGNKAEEDAYHQKFSTIYHLRKYLADSPEKSDLRLVYLALAHMIKYRGHFLIEGELKAENTDVQKLFTDFVEVYDRTFDDSHLSEVTVDASSILTEKISKSRRLENLIESYPKEKKNTLFGNLIALSLGLQPNFKTNFKLSEDAKLQFSKDTYEEDLEEVLEKIGDDYADLFTSAKNLYDAILLSGILTVDDSSTKAPLSASMIKRYAEHHEDLEKLKAFIKTNKPNLYHDIFKDETQNGYAGYIENGVKQDEFYKYLKTILSKTDGSEYFLDKIEREDFLRKQRTFDNGSIPHQIHLQEMHAILRRQGDYYPFLKENQDRIEKILTFRIPYYVGPLARKNSRFAWAEYHSDEKITPWNFNKVIDKEKSAEKFITRMTLNDLYLPEEKVLPKHSHVYETFAVYNELTKIKYVNEQGKEAFFDSNMKQEIFDHVFKENRKVTKEKLLNYLDKEFPEYRIQDLIGLDKENKSFNASLGTYHDLKKILDKSFLDDKVNEEVIEDIIKTLTLFEDREMIQQRLHKYSDIFSTQQLKKLERRHYTGWGRLSYKLINGIRNKENNKTILEYLIDDGYANRNFMQLINDDTLPFKQIIKDAQIIGNIDDIAAVVHELPGSPAIKKGILQSIKIVDELVKVMGHNPDNIVIEMARENQTTNRGRSQSQQRLKKLQDSLKELGSNILNKKKPSYVEDKVENVHLQDDRLFLYYIQNGKDIYTGEELDIDRLSDYDIDHIIPQAFIKDDSIDNRVLTSSAKNRGKSDDVPNLDIVRARKADWVRLYKSGLISKRKFDNLTKSERGGLTEADKAGFIKRQLVETRQITKHVAQILDARFNTEHDEDDKVIRNVKVITLKSNLISQFRKDFKFYKVREINDYHHAHDAYLNAVVGTALLRKYPKLAPEFVYGEYKKYDVRKLITSSSDKATAKYFFYSNLMNFFKRVVRYSNGRVIVRPVIEYSKDTGEIVWNKETDFRTICKVLSYPQVNIVKKVESQTGGFSKESILPKGDSDKLIPRKTKKVYWDTKKYGGFDSPIIAYSVFVVADVEKGKAKKLKKVKELVGISIMERPSFEKNPIVFLEKKGYRNVQEDTLIKLPKYSLFEFEGGRRRLLASASELQKGNEVVLSDRLVELLYHAHRVNSFNSTEHLKYVSEHKKEFGEVLSCVENFANSYVDVEKNLDKIRAVINKIDTFSIEEISTSFVNLLTLTALGAPADFNFLGKKIPRKRYTSTKECLNATLIHQSITGLYETRIDLSKLGEDK

SEQ ID NO: 1046 - protein, 1372 aa, Artificial Sequence
  Cas9
MTKKNYSIGLDIGTNSVGWAVITDDYKVPAKKMKVLGNTDKKYIKKNLLGALLFDSGETAEATRLKRTARRRYTRRKNRLRYLQEIFANEIAKVDESFFQRLDESFLTDDDKTFDSHPIFGNKAEEDAYHQKFPTIYHLRKHLADSSEKADLRLVYLALAHMIKFRGHFLIEGELNAENTDVQKIFADFVGVYNRTFDDSHLSEITVDVASILTEKISKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNILSKIKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKLGEE

SEQ ID NO: 1047 - protein, 1372 aa, Artificial Sequence
  Cas9
MNSDKREDYYVGLDMGTGSLGGAVTDTQYHLLKVKGKDFWFVREYETAKSQLDRRTHRIAKRRLQRHKARIGLIRSYFAEDILKHDPLFYIRQDNSKYYHEDKDVRLTTKDSIFADPGYGDKEYLDDKEYPTIFHLRQALLRDQIKDEERYSRFLYLAIINMFEHRGHFLLNTESSDLNADMIKDVGELVMNAICGVSEYGSVTYKEIIEILEDKNISRTAKKDQIASKIDIKKSEKAQMERIKCLCGMEADARVMFEIEADEKIKIAFQQAAFEDEKEEIEAVIGEDRYLIIENMKQLYDYSQLQSVLNGFDYLSDARVQMYEKHKEDLHLLKKVYRKNLDREIYDRMFRSGEEGSYCAYSNSTNSVDSLAEAKKYRRNMKKRSQKDLYDRIKKDLKEVHDADADAIRKEMELERFLPKQITGANGIIPNQVHRKELKKILENAEHHLDFLKEKDESGYTVSERILMLFSSNIPYYVGPVGSGSKTGWAKIQESGQVLPWNMEQKIDIEQTSERFITNLIRECTYLSGEKVLPKQSLLYESYCVLNEINNLRIHGKRIVPELKQDIYKEVFQGFRLGKKVTKKNICTYLINRGLITEESEVSGIDKEINAYLPSYGKMYGVFGERLREEAVQEIAEKIIYYGTIYGDAKSMFRKKLNQYVSDGWMTEYQAKRISGYKFKDWARLSRSMLCLSGCDKSTGEKISLIRAMWEYNLNFMELIYREDFTFQKELEERRKALGKTLQEFQFEDLDEYYYSAPVKRMIWQAVQALKEITQIMGHNPKRIFIEMTRTEEEKGEQGRKNSREKRLLKMYESIRDERNWAAEIKNANASGKLNSKKLYLYYLQMGRDVYTGEPIDIEDLFDDSRYDIDHIYPRSLTNDNNIENNLVLVSKTINQNEKKNDYPVPEKIRRNKKVRNLWHTLHKMGFMNDEKYNRLTSTERLSEDQLAGFIARQLVETAQGAKGIAELMKAMLPGTDIVYAKARNVSDFRKEYKMLKSRLVNDYHHAQDAYLNIVVGNVYFMKFTRNPMNFVKTEARRDGRNYDYNLYKMYSKDIIRNGEKAWIATSEQGPGTIRLVKETMGRNTPIITRQAFEQRGELFNLQPVGKYSAKKDNYVPLKINDEKMQDVSKYGGYTSLNPSYFIFIEHGPEKKRKKCFEVIHSYYAAQIKTEKDLIDFLLQKGYKNPRVINARIKKNALIKYNGYFLYIIGMDARKNIEFSNATAMCLKNKYIQYVCKLEKMNKAILLSEKQKTNLHWDEKITCESNLELYRELTEKHLHSIYQRHPRSIGKCLADGEGAFKLLDIEEQVKIICDIVQYTSFQRGVFSLKVLGGPKEVGRIRISGNMTEAKECKLVNYSITGMYKTEMDLLKK

SEQ ID NO: 1048 - protein, 1373 aa, Artificial Sequence
  Cas9
MEKTYSIGLDIGTNSVGWSVITDDYKVPAKKMKVLGNTDKKYIKKNLLGALLFDSGETAEVTRLKRTARRRYTRRKNRLRYLQEIFAKEMAKVDESFFQRLEESFLTDDDKTFDSHPIFGNKAEEDAYHQEFPTIYHLRKHLADSSEKADLRLVYLALAHMIKFRGHFLIEGELNAENTDIQKLFNDFVETYDKIADESHLSEVDASSILTNKISKSRRLENLIKQYPTEKKNTLFGNLVALVLGLQPNFKTNFKLSEDAKLQFSKDTYDEDLEELLGKIGDDYADLFTAAKNLYDAILLSGILTVDDNSTKAPLSASMIKRYEEHHEDLEKLKKFIKVNNFDKYHEIFKDKSKNGYAGYIENGVKQDIFYKHLKSIISEKNGGQYFLDKIEREDFLRKQRTFDNGSIPHQIHLQEMRAILRRQGEYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTNRERSQSQQRLKKLQNSLKELGSNILNEEKPSYIEDKVENSHLQNDQLFLYYIQNGKDMYTGDELDIDHLSDYDIDHIIPQAFIKDNSIDNRVLTSSAKNRGKSDDVPSLDIVRARKAEWVRLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEEQTVGQNGGLFDNNILAKPEKDDKKKLFPIKKSLSTTSYGGYARATIAYSILIVSEFGKNKELKLLGLPLLDKVKYEKNPIAYLNSIGIINVKSIFKLPKYCLFEFQEKNTNYRRYMVSNQELKRANQLFLTCKETELVYKYIKSDNDNTHLVGNEKTILSIWNKLVIFMERTKLIDKKLFASLKQLKDEVDLINILDMTAKSLDFTKISAGQKKITISDSLSLPIKRWQFSSDEKMLKQLKTATLIHQSVTGLYETRIDLSKLGEE

SEQ ID NO: 1049 - protein, 1373 aa, Artificial Sequence
  Cas9
MEKTYSIGLDIGTNSVGWSVITDDYKVPAKKMKVLGNTDKKYIKKNLLGALLFDSGETAEVTRLKRTARRRYTRRKNRLRYLQEIFAKEMAKVDESFFQRLEESFLTDDDKTFDSHPIFGNKAEEDAYHQEFPTIYHLRKHLADSSEKADLRLVYLALAHMIKFRGHFLIEGELNAENTDIQKLFNDFVETYDKIADESHLSEVDASSILTNKISKSRRLENLIKQYPTEKKNTLFGNLVALVLGLQPNFKTNFKLSEDAKLQFSKDTYDEDLEELLGKIGDDYADLFTAAKNLYDAILLSGILTVDDNSTKAPLSASMIKRYEEHHEDLEKLKKFIKVNNFDKYHEIFKDKSKNGYAGYIENGVKQDIFYKHLKSIISEKNGGQYFLDKIEREDFLRKQRTFDNGSIPHQIHLQEMRAILRRQGEYYPFLKENQSKIEKILTFRIPYYVGPLARKNSRFAWAKYHSDEPITPWNFDEVVDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKSFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQSSLKELGSNIINEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLAPEFVYGEYKKYDVRKLIAKSSDDHSEMGKATAKYFFYSNLMNFFKTKVKYADGSVYERPIIETNADGEVVWNKQKDFEIIRKVLSYPQVNIVKKVEEQTVGQNGGLFDNNILAKPEKDDKKKLFPIKKSLSTTSYGGYARATIAYSILIVSEFGKNKELKLLGLPLLDKVKYEKNPIAYLNSIGIINVKSIFKLPKYCLFEFQEKNTNYRRYMVSNQELKRANQLFLTCKETELVYKYIKSDNDNTHLVGNEKTILSIWNKLVIFMERTKLIDKKLFASLKQLKDEVNLINILDIASKSIDFTKISAGQKKIVLNDSLSLPIKRWQFKSDEKMLKQLNDATLIHQSITGLYETRIDLSKLGEE

SEQ ID NO: 1050 - protein, 1373 aa, Artificial Sequence
  Cas9
MNLRRARDYSIGLDLGTGSVGWAVTDAEGNLYSFKGRPAMGSRTFPNAEPASVARIPRGQRRRYERRRQRIKLLQQFFMSDMERVDPDFFTRLNQSTLLAEDKDERIASCAWPIFNSSDFTEKDYYKKFPTIYHLRAFLCESDEKGDLRLVYLALHNIVKHRGNFLYQDNPALSASDASVDEAVRQLVDALAEWCQNKEIELSCDAGRIIEVFGDASLRRTDKRDQLKGLLGLPADLAKTMGKELASAVLGYAANFSKIFLISDAEHKFSLGNDEKVEEFETICPNECTSLFSALRTAYSAYLLSGILRDANGKTLSFCKKKEYDRYHDDLALLKALVREYAPESYQSFFGGERLVVNGRMTKRYDPTKAKGYTKYDLVHSAGSYDELAKDVKKLLGSLAADDSRYQRMMQAFDEERFLRRLKTSDNGSIPYQLHLEELRAIIARQGEFYPFLKEESKKIESLVSFRIPYYVGPLTTKNAAVDVHGNKRFAWSERKPGMESAKVRPWNWDDVIDRGKSAENFIVRMTGTCTYLQNEKVLPKCSLLYEEFCVLNELNGAHWSADGDHECPFDTSDRRGIVQDLFCGKRRVSYKQVEDWLRQHGSRRARVSGGQGASGFESKMSSYIFFSKDVLHVDRIDPADFPMIEEIILWNTLFEDRDILKERIEEAYGDRLNAEQIKTICKKRFTGWGRLSRRLLTGIKAQTDQGDLSIMDILREGDPNNDHRGKAMVFMGILHSEDLGFQKKIDQINQEKVSAGKVSLEDLPGSPALRRSINQAMRVVDEIVSIAKCPPSHIYLEVTRDEDGARKGRRSTRRYDAIKAALEKFKEESPTWFDQDVFGEFRRSRAEDLDERLSLYFMQGGKSLYSATPLKLELLHTNQYQVDHIIPQSYIKDDSFENKALVLAGENQRKSDALLIDSSIRTAMAPYWRALHQAGLMGDKKFNSLMCSSISDKRVRGFIARQLVETSQIVKLAGMMLQSNYPEADVQPVKASLGHDLRVQAGFIKCREVNDFHHAHDALIACEVGRYINQCHPGIYDNPIGYARAVRELVRKQNEEMRKYGRLPGSAGFIVGGFMRTHVDVDTGEVVWDAEEELSRIRAYLDYSNVFVTRMSEETSGALWNATIYSPHYGKTAPTLHIKQGLDVQRYGGYSSATFAYFTLYVAEKGKKRKAELLGIPISVARKIEGEPSKLDAFVAQDAEAKKLKHPLIIRARILKYARFEMEGNQFYFAAQDAVYSARQLVLKGDLYSVAAKACDKHLNDSCISNEDLIRLYDELVHKGDLLCNKFGNVTDVLRAGRERYAGLSISEKRQLVCNVLAYYRSATARVDISLVGGPKHAGNLGIAFVLNNPEAIVFVDQSVTGMFEKRTRVEL

SEQ ID NO: 1051 - protein, 1373 aa, Artificial Sequence
  Cas9
MKKILGLDLGTNSIGWALVNEADNEREKSSIIKIGVRVNPLTVDEQQNFEKGKSITTNADRTLKRSMRRNLQRFKLRKENLIEILKKQKFINDETILSENGNKSTFETYNLRAKSATEEITLEQFARVLLMINKKRGYKSSRKAKSQDEGQLIDGMEIAKKLYNDNLTPGQFVFQILKEGKKYIPDFYRSDLQAEFDKIWSFQKQFNPDILTEEFNKQIIGKGKVNTTKIFLAKYGIYTIDNKGADKKSQAYNWRVEALTNQLTKEELAFVISDLNGIISNSSGYLGSISDRSKELYFNKQTVGQYLIAQLKENPHTQLKNQVFYRQDYLDEFNTIWETQAKFHKELTNELKEEIRDIIIFYQRKLKSQKGLISFCEFESKQIEINIDGKKKLKTVGSKVCPKSSPLFQVFKIWQILNNIQVIEKSTGKSKFLEQDEKEILFKELNFKDKISKTDALKILYKNYKELDFNFKENIEGNRTQATFLKAFQSIIELSGHEVSDFSKIKTDEILEIVTPIFEGFGFNTNLLQFNSNLKGKDFEKQAVYQLWHLLYSFEGDNSNTGNEKLIQKISELYGFEREYAIIIANISFQPDYGSLSTKAIRKILPHLKEGIEFSLACEYAGYRHSKNSLTKEEKNKKILKDKIDILPKNSLRNPVVEKILNQMINVVNATIETYGKPDEIRIELARELKKSAKEREDLTNAINKSTLDHEKYKALLQKEFGLSNVSRNDIIRYKLYLELEHNGFHTLYSNTYIEPNKLFSKEFDIEHIIPQSRLFDDSFSNKTIESRSANIEKGNETAFDYVSNKNGEVGLKDYLKNIEDLFNNGKISKTKYNKLKMKGDEIPSDFIARDLRDTQYISKKAKSILEDLVKDVVSTGGSITDRLREDWQLIDIMKELNWDKYDKLGLTEVIENNDGHKINRIKDWTKRNDHRHHAMDALTIAFTKRSYIQYLNNLNARSDKSGSIYGIEQKELYRDKNNKLRFKPPIPLDDFRAEAKKQLENTLVSIKAKNKVATININNTKKQGGENKKKQLTPRGQLHLETIYGSIQQYVTKEEKVGANFNKELIEKVANKKCREALLKRLIEFDNDPKKAFTRKNSLNKNPLYIDTIKTYKVPEKVKTVTTETIYTIRKDINPDLKIDKVVDKKIKNILELRLKEFNGDAKKAFSNLDEKPIWLNKEKGISIKRVTITGISNAIALHDKKDKEGNFILDNQGKKQAVDFVNTGNNHHVAIYKDEKGNLQENVITFYEAVERVNQGIPIIDKTYKQNEGWQFLFSMKQNEYFVFPNEKTGFNSNEIDLLNPENYHLISPNLFRVQKIATKDYFFRHHLETNVENITTTKDLTWKRLGINGIINILKVRINHIGQIVSVGEY

SEQ ID NO: 1052 - protein, 1373 aa, Artificial Sequence
  Cas9
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 1053 - protein, 1373 aa, Artificial Sequence
  Cas9
MENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASGLNAKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 1054 - protein, 1374 aa, Artificial Sequence
  Cas9
METKFTYYLGLDMGTDSLGWAVTDSSYHILRAKGKDLWGVRLFPSAETSVERRTYRVNRRRRQREVARIGALKELFADEIEKVDPGFFVRLDESKFHMEDRSENNKQKYGLFADKLFSDAGYYKKYPTIFHLRKELLESEEPHDVRLVYLALLNMFKHRGHFLNSSLQIEGENSNIAESYQMFVDTLTDEDLDFPEQVSGERLQEIFRSSDSRKKKVENLLAEMNLSKKQKREIQFVNLICGLKGKLSELFPDKEYDEEQKKIAFSFQDSDYEDKENTIQELLDESEMNMIYAVKAVHDSGVLSGIMNGERYLSVARVASYEKHKKDLQILKDILKKYDTKEYFEMFRNESAKSESYSAYVGSVKYHGTFRRGLSGGKQEDLYKHIKKVLGKFPQDDEGVTYILEEIETESFLPKQLTASNGVIPNQVHAREMLAILKHAELYLPFLQEKDDTGLSVSEKILKLFMFQIPYYVGPLGQEYKDKKGYNVWAERKASGKIYPWNFEDKIDVKKSAEKFIGRMVRRCTYLSGEQALPKQSLLYEKFQVLNELNNLRIRGEKIPVSLKQEIYHDLFGDGKKVSMTRLTNYLLQNGVISGEEKDSCISGIDGGFHNSLSSVGKFKGVFGDTVHTDEHRKMIEDIIFWGTVFGDGKKLLKEKVEEVYGNQLTEAQKKRIFGFKFSSWGRLSKAFLTMEGASKDDGEIKGLIQAMWDTNCNLMELLSDRFTYKDKLNEMVTTAEKPLCEWKIEDLDEMYLSAPVKRMVWQTIRVVDEVQQIIGCPPKRIFVEMTRSDGEKGKRTVSRQKKLVDLYKALGKEGKTWSEELSDTPESQFRIKKLYLYYLQMGKCMYTGEAIELEQLMNDNLYDIDHIYPRHFIKDDNISNNLVLVKKEKNAHKSDSFPIEPEIRNKMMPFWKSLRKKGFLTEEKYNRLTRMSAFTDEEKAAFIGRQLVETSQGTKAITQIFEQAFANSEIVFSKASVVSAFRQKFDCYKVRCVNNYHHAHDAYLNIVAGNTYRVKFTSNPLNFIKEAKKNPNSRENRYNMDKIFEWDVTRNGETAWVAQTKEHPGTIQLVKKYLNKNSPLITKMVYEKHGGITQKATIWSAKKAESGNTDAYIPVKMNDPRLADVTKYGGVTTIAVAGYTLLEYKAGGKTVRSLEALPIYLGGSKKLTEEQMVEYFSNVLQQENKEKVVSDVIIRKKMIPSGSLIKYNGFYYYLAGKTGDRIILISAVQLCLPMDTMLYIKKIEKACSTGNFEEKDKNGKQVLSKQQNEFVYELIIQKYQQSIFKKKVGAIGDTIIEKREKFAEISLEEQCKVLMQIFLNFQSGIGVELKIIEGGKKSGVTYLNKKVMNVQELKLIDQSVTGVFSREIDLLTI

SEQ ID NO: 1055 - protein, 1374 aa, Artificial Sequence
  Cas9
MKKRYSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 1056 - protein, 1374 aa, Artificial Sequence
  Cas9
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 1057 - protein, 1375 aa, Artificial Sequence
  Cas9
MSNKPYSIGLDIGTNSVGWAVITDDYKVPSKKMKVLGNTDKHFIKKNLIGALLFDEGTTAEDRRLKRTARRRYTRRKNRLRYLQEIFFEEMSKLDSGFFHRLDDFFLIPEDKRGSKYPIFATLAEEKEYHKQFPTIYHLRKQLADSKEKADLRLIYLTLAHMIKYRGHFLYEESFDIKNNDIQKIFNEFISIYDNTFEGSSLSGQNAQIEAIFTDKISKSAKRERVLKLFPDEKSTGLFSEFLKLIVGNQADFKKHFELEEKAPLQFPKDTYDEDLENVLGQIGDDFADLFVAAKKLYDAILLSGILTVTDPSTKAPLSASMIERYENHQKDLAALKQFIKTNLPEKYVEVFSDQSKDGYAGYIDGKTTQEAFYKYIKNLLSKFEGTDYFLDKIEREDFLRKQRTFDNGSIPHQIHLQEMNAILRRQGEHYPFLKENKEKIEKILTFRIPYYVGPLARGNRDFAWLTRNSDQAIRPWNFEKIVDKASSAEDFINKMTNYDLYLPEEKVLPKHSLLYETFAVYNELTKVKFIAEGLRDYQFLDSGQKKQIVNQLFKEKRKVTKKDIIHYLHTVDGYDGIELKGIEKQFNASLSTYHDLLKIIKDKKFMDDSKNEAILENIVHTLTIFEDREMIKQRLAQYDSLFDEKVIKALTRRHYTGWGKLSAKLINGICDKQTGNTILDYLIDDGEINRNFMQLINDDGLSFKKIIQKSQVVGETDDVKQVVRELPGSPAIKKGILQSIKIVDELVKVMDHAPESIVIEMARENQTTARGKKNSQQRYKRIEDSLKNLASGLDSNILKENPTDNIQLKNDRLFLYYLQNGKDMYTGEALDINQLSSYDIDHIIPQAFIKDDSLDNRVLTSSKDNRGKSDNVPSLEVVQKRKAFWQQLLDSKLISERKFNNLTKAERGGLNERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLKRYISRSRNPKEVEKATEKYFFYSNLLNFFKEEVHYADGTIVKRENIEYSKDTGEIAWNTEKDFATIKKILSYPQVNIVKKTEEQTVGQNGGLFDNNIVSKEKVVDASKLIPIKSGLSPKKYGGYARPTIAYSVLVTYKQNNKIKNTMVGIPVLTKLEFERDPNLYLRNLGINNVSHVIKLVKYTVLEFKHKYGTYRRFIVSNQELKRANQIFVTTKQMKLISQYTTLDKNEHDSLLKNNQQLIQSIWNQFLEFMLATDLVNKKQYDELILTNNQTIEECRNIMNRVITTLSFTNINAGQKKIIFDDTLSLPIKRWQFTDSDKMVKKIIESTLIHQSITGLYETRIDLSKLGED

SEQ ID NO: 1058 - protein, 1375 aa, Artificial Sequence
  Cas9
MKEYHIGLDIGTSSIGWAVTDSQFKLMRIKGKTAIGVRLFEEGKTAAERRTFRTTRRRLKRRKWRLHYLDEIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMVNGNEWKIDLSSETSEDEIEKFREELSDAQNDILTEITSLFSQIMLNEIVPNGMSISESMMDRYWTHERQLAEVKEYLATQPASARKEFDQVYNKYIGQAPKEKGFDLEKGLKKILSKKENWKEIDELLKAGDFLPKQRISANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKASDVASLVMAKTRGVNKPSVEGLSDPKKFNSNLATYLDLKSIVGDKVDDNRYQMDLENIIEWRSVFEDGEIFADKLTEVEWLTDEQRSALVKKRYKGWGRLSKKLLTGIVDENGQRIIDLMWNTDQNFMQIVNQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKVPDLSDRYYFYFTQGGKDMYTGDPINFDEISTKYDIDHILPQSFVKDDSLDNRVLTSRKENNKKSDQVPAKLYAAKMKPYWNQLLKQGLITQRKFENLTMDVDQTIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVADYFDWVQDLKLMLVTKELKRSNGKLFDATIQNANYTKLNERKKVFVPLKKELDKTLYGSYSGIQSSYMTIVKKFDKKGSTYAVQRIPVMYSKLLELEKEQSKLNRLVQSIVTSDPQAPNNFEVLMPCVLSGQLVIDNGRKFTLTSYRYQCSTAQLFLPKKDLKYIQNNFKELKKTPDKQDKIFETIYDDILKQVDKYFSLYDINKFRSKLHDGKDKFLALENFGEKESKDKVITKILRGLHANAERTSLKEIGLSTPLGQFQSGEGGITLSDNTKIIYQSPTGLFERHVYLKDL

SEQ ID NO: 1059 - protein, 1375 aa, Artificial Sequence
  Cas9
MRKNQEPYNIGLDIGTSSIGWSIMNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 1060 - protein, 1375 aa, Artificial Sequence
  Cas9
MENKKYSIGLDIGTSSIGFAVVDENNRVMRVKGKNAIGVRLFSEGQPAADRRSFRTTRRRLSRRRWRLRLLREIFEPYINPVDEAFFMRLKESNLSPKDANKHYSGDILFNNQTDQDFYEKYPTIYHLRHALMTEHRKFDVREIYLAIHHIVKFRGHFLNAASASNFTVGKLNLEGKFDALNEIYQRVLTDDPFALRTDNLDHIKEILIDNKRSQADRQRTLTGDVYQSSEEKEIEKRNKAIATEILKAAVGNKAKLNVITNVEVDKEAAKDWSLTFDSETIDDELAKVDGQMTDDGREIIEILRSLYSGITLAAIVPENHTLSQSMVEKYNSHKAHLKLLKDLINNMTDTKKAKNLRAAYDGYIDGVKGKVLTRDDFYKQIQGNLDDSAEAQKIQDVMDQDEFMPKQRTKANGSIPHQLQQQELDQIVENQKEYYPWLAEENPNETRRGVAKYKLDELVTFRVPYYVGPMITAEDQEKQSGASFAWMKRKEPGNITPWNFDQKVDRMASANQFIKRMTTTDTYLLGEDVLPAQSLLYQRFEVLNELNKIRIDRKPISIELKQQIFNDLFKKFKNVTIKHLQEYLVATGGYDKRPRIDGLADEKRFNSGLSAYHDLHGILGAEVVDANDKQDDLEKIIEWSTIFEDKKIYRAKLDELTWLTDSQKEKLATKRYQGWGRLSKKLLSGLRNSDHRSILDILWITNENFMQIQADPDFAELVKNANQGMLGKNNSQDVINDLYTSPQNKKAIRQILLVVHDIQNAMHGQAPAKIHVEFARGEERNPRRSIQRQHQIEAAYDKVTSDLLVDAGVRQELKDAINDKRDFKDRLFLYFMQGGRDIYNGEPINIDRLSSYDIDHILPQAFVKDDSLNNRVLTDAEGNRRKSDAVPSELFGAKMRSTWELMREQGLISKAKYRNLTMNPENINAHTENGFINRQLVETRQVIKLAVNILADEYTEDTQIVSVKADLSHQMREDFELLKNRDVNDYHHAFDAYLAAFIGNYLLERYPKLQSYFVYGDFKKFSQKDTKMRRFNFIYDLKHSDQIADKNGKKIWHKTNDLDYIRHLFAYKKILISHEVSERRGALYNQTVYKASDDKASGQGSKKLIPIKANKPTEIYGGYTGKTLAYMAIVKVIKGKKIAYKVVGVPTSALVQLAGIEHGSQEELNRLYDVLKPQFTQLKKNNKTGEISETVSKFEIVIPRVKYQQLVEDDDKLFMIGSDTYPYNAQQLVLSEGALKVINNVYRKGENSDKQESYKLDDVYDEIIIAMKKYFPLYDNRGFREKVAEGKSTFENLPISNEFKNGKLTKIGKKEVINRMLQGLHANATMTDLKILGIKSPFGFMQQPTGIALSENAQLIYQSPTDLFERRVQLNKIK

SEQ ID NO: 1061 - protein, 1375 aa, Artificial Sequence
  Cas9
MKKILGLDLGTTSIGWALVYESENTDEKSSIVRLGVRVNPLSVDEKGNFEKGKAITTNADRQQTHGARINLQRYKLRRENLKDCLQKQGWIGTEALCEEGKTSTFETYMLRAKAAEEEISLHELCRVLFMMNKKRGYKSNRKANNKEDGKLFDGMTVAKKLYEEHLTPAEYSFQLLSSGKKFKQEYYRSDLKEEFDRIWNEQQKYYPEILTDDFKQQLQGKSKGNTSKIFLGKYGIYSADLKGLDRKLQPLKWRVEALKQQVDKEVLAFVISDLNGQIASTSGLLGAISDRSKELYFNKQTVGQYLWTSLKETPHVSIKNKPFYRQDYLDEFEKIWETQATYHKELTPELKQEIRDIIIFYQRPLKSKKGLISVCELEQRKVKVTIDGKEKEISIGPKVAPKSSPMFQEFRIWQNLNNILLIDKGNNSIHPLYEEEKNLLYEELSVKEKLSKAEALKVLNKNSKQWDLNYKEIEGNRTQAVLYDCYNRIIVMTGHEEYNFKKLKASEIRSYVKTTFTGLGFNTDILEFDSSLTGHELEKQPMYQLWHLLYSYESDNSRTGNDALLRKLETAFGFPKEYAAVLSDVVFEDSYGNLSVKAMRKILPHLQAGLNYSQACEEAGYKHSRRSLTKNELDQKEYKEKLELLPKNSLHNPVVEKILNQMINVINAVIDEYGKPDEIRIELARELKIGAAERENMTRSINQGNAENKRIREILEKEFALSYISRNDIIKYKLYEELKSNGFKTLYSDTYISKDKLFSKDFDIEHIIPKARLFDDSLSNKTIEARDVNIAKSNKTAFDFISEKYDQQGIEAYKKKLDILLQDGSISKAKYNRLLMKEADIPSGFIDRDLRDTQYIAKKAYEILSDLVRNVTPTTGAVTSRLREDWQLVDVMKELNFEKYQKLGLVEVIEDRDGRKIKRIKDWTKRNDHRHHAMDALTIAFTKPSYIQYLNNLNARSDKNSSIYGIENKELHREDNKLRFNAPLPINEFRAEARRHLKSILVSVKAKNKVMTQNVNVIKTKHGVIKKVQLTPRGELHNATFYGTKKRPIIKMVKVGAALDEVTIKKVSSSFIREALLDRLHEYNGDAKKAFTGRNSIDKNPIYIDEEHKKTVPALVKTIEWEMYHPTRKLISPDLKIDKVIDKGIREILKTRLAKFNGDAQKAFSNLDENPIYKDEAKKITLKRVSLEGVSSVIPLHTLKDREGKLVVGKDGKPVLGDYVQTSNNHHIAFYMDENGNLQDNVVSFFEAAERKSQGVPVIDKNYNHDKGWNFLFTMKQNEYFVFPNEVTGFNPSEVDLMDEANYSIISPNLYRVQKMSKASGRDYWFRHHLEAMLNDDPKLRNSMFKRITSLKALEGIVKVRINCIGKIVAVGEYD

SEQ ID NO: 1062 - protein, 1375 aa, Artificial Sequence
  Cas9
MSNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLQRYISKSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 1063 - protein, 1375 aa, Artificial Sequence
  Cas9
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 1064 - protein, 1375 aa, Artificial Sequence
  Cas9
MKKILGLDLGTTSIGWALVNESENKDEQSSIVRLGVRVIPLTVDEKGNFEKGKAITTNADRQQVHAARINLQRYKLRRENLRDCLQKQGWIGSEPMCEDGKSSTFETYKLRAKAAVEEVSLHEFARVLFMLNKKRGYKSNRKANDKEEGKLFDGMTIAKKLYEEHLTPAEYSLQLLNTGRKFTPEYYRSDLIEEFEKIWNEQQKYYPEILTDEFKQQLEGKAKSNTSKLFLGKYGIYSADTKGLDRRLQPLKWRVEAMKQQVDKDVLAFVISDLKGQIANTSGLLGAISDRSKELYFSKQTIGQYLWASLQENPHISIKNQPFYRQDYLDEFEKIWETQATYHKELTSELKQEIRDIIIFYQRPLKSKKNLIAVCELEQRKVKVTVDGKEKEITIGPKIAPKSSPMFQEFRIWQNLNNILLLDHETNSKRPLYEEERNLLYEELSVKEKLSKTEALKVLGKKSKQWDLNYKELEGNRTQAVLYDCYNRIIVMSGHEECNFKKLKASDIRHYVKMIFKNLAFNTDILCFDSSLKGHELERQPMCQLWHLLYSYEGDNSRTGNDALLRKLETSFGFPKEYAAVLADVIFEDSYGNLSVKAMRNILPHLQAGKDYSQACEEAGYKHSRRSLTKEELNQKVYKEKLELLPKNSLHNPVVEKILNQMVNVINAVIEEYGKPDEIRIELARDLKIGAAERENMTRSINQGNAENKRIREILEKEFALSYLSRNDIIKYKLYEELKSNGFKTLYSDTYISKDKLFSKDFDIEHIIPKARLFDDSLSNKTIEARDVNIAKSNKTAFDFILERYGEQGVKTYKTKLLRLLEDGAISNKKYNNLLKTEADIPSGFIDRDLRNTQYIAKKAYEILSELVKIVTPTTGSVTNRLREDWQLVDVMKELNFEKYQKLGLADVIEDRDGRKVKRIKDWTKRNDHRHHAMDALTIAFTKPSYIQYLNNLNARSDKSSSIYGIEVKELHREEGKFRFNAPLPINEFRAEAKRHLKSVLVSIKAKKKVMTQNVNKIKTKHGIIKKVQLTPRGELHNATYYGTKKRPLVRMVKVGAALDEATIKRVCSPAIRAALLKRLNAYNGDAKEAFTGRNSIDKNPIYLDIEQTKLVPVLVKTIEWGMYHPIRKRITPDLKIDKVIDKGIREKLKARLAEFNGDAQKAFSNLDENPIYMDEAKRITLKRVSIEGVLSAIPLHTLKDKAGKPVIGSDGKPVFGDYVQTSNNHHIAFYIDDKGNLQDNPVSFFEAAERKSQGVPVIDRRYNCDKGWHFVFTMKQNEYFVFPNEATGFIPSEVDLLDEANYCIISPNLYRVQKLSKASGRDYWFRHHLETMLNDDLRLKNSTFKRIQSLKGLEDIVKVRINSIGKIVAVGKYD

SEQ ID NO: 1065 - protein, 1375 aa, Artificial Sequence
  Cas9
METKFTYYLGLDMGTDSLGWAVTDSSYHILRAKGKDLWGVRLFPAAETSVDRRTYRVNRRRRQREVARIGALKELFADEIEKVDPGFFVRLDESKFHMEDRSENNKQKYGLFADKLFSDAEYYKKYPTIFHLRKELLESEEPHDVRLVYLALLNMFKHRGHFLNSSLQIEGENSNIAESYQMFVDTLKDEELDFPEQVSGERLQEIFRSSDSRKKKVENLLAEMNLSKKQKREIQFVNLICGLKGKLSELFPDKEYDEEQKKIAFSFQDSDYEDKENTIQELLDESEMNMIYAVKAVHDSGVLSGIMNGERYLSVARVASYEKHKKDLQILKDILKKYDTKEYFEMFRNESEKSENYSAYVGSVKYHGTFRRGLSGGKQEDLYKHIKKVLGKFPQDDEGVTYVLEEIETESFLPKQLTASNGVIPNQVHAREMLAILKHAELYLPFLQEKDDTGLSVSEKILKLFMFQIPYYVGPLGQEYKDKKGYNVWAERKEPGKIYPWNFEEKIDVKKSAEKFIGRMVRRCTYLSGEQALPKQSLLYEKFQVLNELNNLRIRGEKIPVSLKQEIYHDLFGDGKKVSMTRLTNYLLQNGVISSEEKDSCISGIDGGFHNSLSSVGKFKGVFGDTVHTDEHRKMIEDIIFWGTVFGDGKKLLKEKVEEVYGNQLTEAQKKRIFGFKFSGWGRLSKAFLTMEGASKDNGEIKGLIQAMWDTNCNLMELLSERFTYKDKLNEMVTTAEKPLCEWKIEDLDEMYLSAPVKRMVWQTIRVVDEVQQIMGCPPKRIFVEMTRSDGEKGKRTVSRQKKLVDLYKALGKEGKIWSEELNNTPEGQFRIKKLYLYYLQMGKCMYTGESIELEPLMNDNHLYDIDHIYPRHFIKDDNISNNLVLVKKERNAHKSDSFPIEPEIRNKMMPFWKSLRKKGFLTEEKYNRLTRMSAFTDEEKAAFISRQLVETSQGTKAITQIFKQAFADSEIVFSKASVVSAFRQKFDCYKVRCVNDYHHAHDAYLNIVAGNTYRVKFTSNPLNFIKEAKKNPNSRENRYNMDKTFEWDVTRNGETAWVAQSNENPGTIQLVKKYLNKNSPLITKMVYEKHGGITQKATIWSAKKAESGNTDAYIPVKMNDPRLADVTKYGGVTTIAVAGYTLLEYKAGGKTVRSLEALPIYLGGSKNLTEEQMVEYFSNILQQENKEKVVSDVIIRKKMIPSGSLIKYNGFYYYLAGKTGNRIVLISAVQLCLPMDTMLYIKKIEKACSTGNFEEKDKNGKQVLSKQQNEFVYELIIEKYQQSIFKKKVGAIGDTIIEKREKFAEISLEEQCKVLMQIFLNFQSGIGVDLTSVDGSNKSGVTYLNKKIMNAQELKLIDQSVTGVFSREIDLLTI

SEQ ID NO: 1066 - protein, 1375 aa, Artificial Sequence
  Cas9
MSNKSYSIGLDIGTNSVGWAVITDDYKVPSKKMKVLGNTDKHFIKKNLIGALLFDEGTTAEDRRLKRTARRRYTRRKNRLRYLQEIFSEEMSKVDSSFFHRLDDSFLVPEDKRGSKYPIFATLAEEKEYHKKFPTIYHLRKHLADSKEKTDLRLIYLALAHMIKYRGHFLYEESFDIKNNDIQKIFSEFISIYDNTFEESSLIGQNAQVEAIFTDKISKSAKRERVLKLFPDQKSTGLFSEFLKLILGNQADFKKHFDLEEKAPLQFSKDTYDEDLENLLGQIRDDFADLFLVAKKLYDAILLSGILTVKDLSTKAPLSASMIEHYENHQKDLAALKQFIQNNLQEKYDEVFSDQSKDGYAGYINGKTTQEAFYKYIKNLLSKFEGADYFLDKIEREDFLRKQRTFDNGSIPHQIHLQEMNAILHRQGEHYPFLKENKEKIEKILIFRIPYYVGPLARGNRDFAWLTRNSDEAIRPWNFEEIVDKASSAEDFINKMTNYDLYLPEEKVLPKHSLLYETFAVYNELTKVKFIAEGLTRYQFLDKKQKKDIFYTFFKAEDKRKVTEKDIIHYLHTVDGYDGIELEGIEKQFNASLSTYHDLLKIIKDKEFMDDDKNEAILENIVHTLTIFEDREMIKQRLAQYNSLFDEKVIKALTRRHYTGWGKLSAKLINGIRDKKSGKTILDYLIDDGEINRNFMQLIHDDGLSFKEIIQKAQVFGKTNDVKQVVHELPGSPAIKKGILQSIKIVDELVKVMGHAPESIVIEMARENQTTARGKKNSQQRYKRIEDSLKNLASGLDSNILKENPTDNVQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQILDTRFNKEVTEKDKKNRNVKIITLKSNLVSNFRKEFGLYKVREINDYHHAHDAYLNAVVAKAILKKYPKLEPEFVYGEYQKYDLKRYISRSKDPKDIEKATEKYFFYSNLLNFFKEEVQYADGTIAKRENIEYSKDTGEIAWNKEKDFATVKKVLSLPQVNIVKKREVQTGGFSKESILPKGNSDKLIPRKTKDILWETTKYGGFDSPVIAYSILLIADIEKGKSKELKTVKTLVGITIMEKATFEENPITFLENKGYHNVRKENILCLPKYSLFELENGRRRLLASAKELQKGNEIVLPVYLTTLLYHSKNLHKLDEPGHLEYIQKHRNEFKDLLNLVSEFSQKYILADANLEKIQNLYADNEQADIEILANSFINLLTFTTLGAPAAFKFFGKDIDRKRYTTVSEILNATLIHQSITGLYETRIDLSKLGED

SEQ ID NO: 1067 - protein, 1375 aa, Artificial Sequence
  Cas9
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKEFGSDILSKKKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 1068 - protein, 1375 aa, Artificial Sequence
  Cas9
MTKIKDDYIVGLDIGTDSCGWVAMNSNNDILKLQGKTAIGSRLFEGGKSAAERRLFRTTHRRIKRRRWRLKLLEEFFDPYMAEVDPYFFARLKESGLSPLDKRKTVSSIVFPTSAEDKKFYDDYPTIYHLRYKLMTEDEKFDLREVYLAIHHIIKYRGNFLYNTSVKDFKASKIDVKSSIEKLNELYENLGLDLNVEFNISNTAEIEKVLKDKQIFKRDKVKKIAELFAIKTDNKEQSKRIKDISKQVANAVLGYKTRFDTIALKEISKDELSDWNFKLSDIDADSKFEALMGNLDENEQAILLTIKELFNEVTLNGIVEDGNTLSESMINKYNDHRDDLKLLKEVIENHIDRKKAKELALAYDLYVNNRHGQLLQAKKKLGKIKPRSKEDFYKVVNKNLDDSRASKEIKKKIELDSFMPKQRTNANGVIPYQLQQLELDKIIENQSKYYPFLKEINPVSSHLKEAPYKLDELIRFRVPYYVGPLISPNESTKDIQTKKNQNFAWMIRKEEGRITPWNFDQKVDRIESANKFIKRMTTKDTYLFGEDVLPANSLLYQKFTVLNELNNIRINGKRISVDLKQEIYENLFKKHTTVTVKKLENYLKENHNLVKVEIKGLADEKKFNSGLTTYNRFKNLNIFDNQIDDLKYRNDFEKIIEWSTIFEDKSIYKEKLRSIDWLNEKQINALSNIRLQGWGRLSKKLLAQLHDHNGQTIIEQLWDSQNNFMQIVTQADFKDAIAKANQNLLVATSVEDILNNAYTSPANKKAIRQVIKVVDDIVKAASGKVPKQIAIEFTRDADENPKRSQTRGSKLQKVYKDLSTELASKTIAEELNEAIKDKKLVQDKYYLYFMQLGRDAYTGEPINIDEIQKYDIDHILPQSFIKDDALDNRVLVSRAVNNGKSDNVPVKLFGNEMAANLGMTIRKMWEEWKNIGLISKTKYNNLLTDPDHINKYKSAGFIRRQLVETSQIIKLVSTILQSRYPNTEIITVKAKYNHYLREKFDLYKSREVNDYHHAIDAYLSAICGNLLYQNYPNLRPFFVYGQYKKFSSDPDKEKAIFNKTRKFSFISQLLKNKSENSKEIAKKLKRAYQFKYMLVSRETETRDQEMFKMTVYPRFSHDTVKAPRNLIPKKMGMSPDIYGGYTNNSDAYMVIVRIDKKKGTEYKILGIPTRELVNLKKAEKEDHYKSYLKEILTPRILYNKNGKRDKKITSFEIVKSKIPYKQVIQDGDKKFMLGSSTYVYNAKQLTLSTESMKAITNNFDKDSDENDALIKAYDEILDKVDKYLPLFDINKFREKLHSGREKFIKLSLEDKKDTILKVLEGLHDNAVMTKIPTIGLSTPLGFMQFPNGVILSENAKLIYQSPTGLFKKSVKISDL

SEQ ID NO: 1069 - protein, 1376 aa, Artificial Sequence
  Cas9
MSNFDNHKDSICKHKGLKKGNYYIGLDIGTNSVGWAATNEQYELLKFKSHKMWGSRLFAEAQTAVDTRMKRSARRRLQRRKFRLILLESLFSKEINAVDETFFMRLHESNYHVEDKTNLVKYTLFIDKNYTDVDYYKEFPTIYHLRHHLMTEGTKDIRLLFLAIHHILKYRGNFLYGKKEFSVDGEMYSVLRSTLEELGFGSYVEDENVLQSIANLVLDRGIARSEKVKQIEPLIAQGKKLSSVEKNRLKAWAYLIMGLKANLVNLFTDEDVEVVLPEEKEFKSINLHEGIYEDVRDAYEDAWGDRFAIVDQCKVLHDIIVISSIIKPGQSLSEAKIESYNQHKEDLVLLKSVLKEDKKLYDDMFVVDIDKGTNYVKYIKQGVNGNTSTTQEAFYKYVRKVVSVLPETENTRCIVQKLEEGTFLPLQRISKNGVVPYQLHKEELVRILEKAKLNFPFLNEVEDGLTVADKIISILEFKIPYYVGPLNPTHSIENGGFAWVVRKEAGQVLPWNFEQKVDVQASAVKFIENLTNKCTYLIDQDVLPKYSLLYAEFSLLNELNNIRVNDKPLPADVKQAFIRDHFISLQDSKTATKKVVAKYLVDNNYVSQPPIITGMDQQIATKLTSHRDMTRILGEHFDYAMAEDIIRYITIFGESKDMLRQVLKNYYGDRLTTEQIKKLGKLTYTGWGRLSKKFLSDIWGMKKNDDDAEAGTIIEHMREGQENLMQLLSSSYSFIDVVQEYVTNVLGAKEKTAFEMLEDLSLSPMVKRSVWQTLRILDEIVSIRKELPKKIFVEVARTNKADKKRTQSRKALLEELYEQIKDEDVHVLQQELESKEDSALNSKKLYLYFTQMGRCMYSGRRIDIHELFTDTYDIDHIYPRSLTKDDSWHNIVLVEKQLNAEKTDRFPILSAIQSKQKGFWKLLWDRGFISEKKYDRLVRTTDLTDEELNQFINRQIVSTNQSVKAVTTLLHQLYPETEVVFSKAENISDFRRDYGFVKVRSINHHHHAKDAYLNIVVGNVYHEKFTKNFLSFAKQKGTHRTYNLTKMFEYEIKLTEESKKVIWDPNIHMDIVKKMMKSNDVRVTQRAVPQKGGLSDETIYKKGIAKRGVYLPLKSSDERVRDVEKYGGRTSITISEYIILNIRDTSDQDRIEIFSLPLYIAGKKDIHKAIEEAYLSTCKKPASVVDIQILYRGLYIGSKVNINGFTYYMGGKTGSNVSVDSAVDVVMDITSSVYIKLLEKVAIKKIENSKTFRIENIKTSYNHKEVTVSKEQNIALYQELLKKLDTPLFSKMKGNKLEEFRTVGFDTFIALSLEDQASVLLEVLNVLTNFKTKRDITKIGMTSSRSTLGINISNTEQFSVITTSITGLYEQEIKIK

SEQ ID NO: 1070 - protein, 1376 aa, Artificial Sequence
  Cas9
MTTKNREKNNKFHKASPLYTLGLDIGTTSVGFTAIDEAQRPMRAKGKTVIGVRLFQEGQSAVGRKNFRTTRRRLKRRRRRLNLLKQFFSAPLRKIDPTFFKRLKASSLSPADKRRYLAPGLFPNGGDIKFYQKYPTIYHLRLALMTEKRPFDLREVYLAIHHIVKYRGNFLNPLPVSAFRGRNQRFEDQFSELNQLYKSLEGESPFQFDEKIFSELDKQLLVNDGRKIDRQKQLAKRVFIKTNEKRIDSHHQKIASAFSKAVFGYKFRPDVLLNSDPNESIDEFIKFGDEDFDDKLVILRESLNATQKEILAVTQRIYSQIILNEIVPSRETLSEAMVSRYQKHHSDLQLLTEACKKMTKAKAARIQAAYTDYIGKGDGHKLVHDQFVALIKKNLDPSEEGRDLAERLAQDDFMPLQRTPLNRVIPHQLQQEELDRIIENQGEYYPFLKTLNPNRSRAGVANYQLDELVSFRIPYYVGPLITATDQLHTSGAKFAWMTRRAAGEITPWNFDQKVDRLASANQFIRQNMPKDNHLLEADVLPANSLTYQRYLVLDELNAVKVNHKSLTVSQKQRIFNDLFKRQRTVTVLNLQNYLKSIEKLPTLPVITGVSDSERFKTTLSTYLDFKNIFGGKVDDSSQKEKFEKIILYATIFEDHAVYKAKLDQIDWLGQQQKTDLLSKNYQGWGQLSEKLLLGLKNQAGQSILDELWQTNKRFREIMNEAHFAKQIMASNAALLRKKGLDDVLSTAFLSPQNKKAIRQTVEVVDDIVKAIGCPPQKISLHFSKAPADAIRHERDNANIILRTYRNLPAKMVDDQLKAELQATAEKHQVLSDKLYLYFTQLGRDLYTGEMLKMSELENDMIDHIMPQTFAYDDSVNNRVLVSQNHSSQLGKTSGEKSDAKMIRFWQVLRDNKLISEQKYQNLTLDSDHLSKSTREQLLNRYLVEKNPITQWVASVLTEKYGDNGTRVLTINPRMVYQMRRQFNLVNLPEVNDYDHGLDAYLAAFIGNYVDRRYPRLRSYFVYGDFSSSKEIVFRLNRFNFLFDLGQAEPNELTDWETGEMIWDKAAANSVLRDVYQYKFMLISQAVYSRQGAMFNQTIYPASQAAGRQLIPVKKNRATKLYGGYSGNVDAYLAIVRLGGPKSDQYRVVGIPTRMVGRLQSAMKQGADTYANTLHKILQPQFTKRKKNRQTGYYEETTEPFAVILDKVYYRQLIIDGQQKFMLGSSTYQFNAKQLVLSSRARQILSGEERLTDENGSQDLIDVYDEILTKIDRYFELYDQRHFRQSLHDGRKQFISLPIHNVYRANRLIEHGKYETLSQILNGLHANTMMTNLRYLGISSPFGKFQSPNGIKLSKDAVLVYQSPSGLFERRVRLRDL

SEQ ID NO: 1071 - protein, 1376 aa, Artificial Sequence
  Cas9
MNNKPYSIGLDIGTNSVGWAVITDDYKVPSKKMKVLGNTDKHFIKKNLLGALLFDEGTTAEDRRLKRTARRRYTRRKNRLRYLQEIFTEEMSKVDISFFHRLDDSFLVPEDKRGSKYPIFATLEEEKEYHKNFPTIYHLRKHLADSKEKADFRLIYLALAHIIKYRGHFLYEESFDIKNNDIQKIFNEFISIYDNTFEGSSLNGQNAQVEAIFTDKISKSAKRERVLKLFPDEKSTGLFSEFLKLIVGNQADFKKHFDLEEKAPLQFSKDTYDEDLENLLVQIGDDFADLFLVAKKLYDAILLSGILTVTDPSTKAPLSASMIDRYENHQKDLAALKQFIKTNLPEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKARSAEDFINKMTNYDLYLPEEKVLPKHSLLYETFAVYNELTKVKFIAEGLRDYQFLDSGQKQQIVTQLFKEKRKVTEKDIIQYLHNVDSYDGIELKGIEKQFNASLSTYHDLLKIIKDKEFMDDSKNEAILENIVHTLTIFEDREMIKQRLAHYASIFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKVMGHAPESIVIEMARENQTTARGKKNSQQRYKRIEDALKNLAHGLDSNILKEHPTDNIQLQNDRLFLYYLQNGKDMYTGKSLDINQLSSCDIDHIIPQAFIKDDSLDNRVLTSSKDNRGKSDNVPSLEIVQKRKAFWQQLLDSKLISERKFNNLTKAERGGLDERDKVGFIKRQLVETRQITKHVAQILDARFNTEVTEKDKKDRSVKIITLKSNLVSNFRKEFRLYKVREINDYHHAHDPYLNAVVAKAILKKYPKLEPEFVYGDYQKYDLKRYISRTKDPKEVEKATEKYFFYSNLLNFFKEEVHYADGTIVKRENIEYSKDTGEIAWNKEKDFATIKKVLSLPQVNIVKKTEEQTVGQNGGLFDNNIVSKKKVVDASKLTPIKSGLSPEKYGGYARPTIAYSVLVIADIEKGKAKKLKRIKEMVGITVQDKKKFEANPIAYLEECGYKNINPNLIIKLPKYSLFEFNNGQRRLLASSIELQKGNELIVPYHFTALLYHAQRINKISEPIHKQYVETHQSEFKELLTAIISLSKKYIQKPNVESLLQQAFDQSDKDIYQLSESFISLLKLISFGAPGTFKFLGVEISQSNVRYQSVSSCFNATLIHQSITGLYETRIDLSKLGED

SEQ ID NO: 1072 - protein, 1376 aa, Artificial Sequence
  Cas9
MDKKYGIGLDIGTSSIGWTVVDKYGHIIRVKGQTGIGVRLFREGQTAAERRTFRTTRRRLSRRRWRLRLLREIFDEPISAIDENFFARQKASSLAPGDARYQQAFQLFNDRTDQAFYCKYPTIYHLRQALMTESRQFDIREIYLALHQIIKYRGHFLLGGAAKDFQSDKLDLEAYFTTINAQLAGIYSDGSVQLPTLDWNQACQELTDTSRTQSDRKNWLVKELKSYGDSQLKPIYTQIANAILGFKTDLAKIMGINDPEKALSFNLDALDDHRDDVAELLTDEQIPLVNLLAKLHTALELAAILPDGQTLSGKMVEIYETHRKQLKTYKAFIRQLPDRQQRLALKQAYDHYIDQGLNREAFYSEVKAILEKQKPLTATGQAMKKAMDQNAFLLKQRTKTNIAIPYQVQQQEMDQIIANQSKYYPWLATPNPVKSRRVIAPYKLDELVCFRVNYYVGPLVQSKPGEATKEAKFAWMTRKDPQSTVAITPWNFDQQVDRQASANAFIQRMKTTDTYLLGEDVIPKNSLLYQKYEVLNELNNVRVNGDWLDPQRKQYLFKKLFMDQPQSVVTVKALQKTLVVIGACPTLPTVEGLANPKRFLSQLTTYHDFCKLLPDDIQRADRQADIEKIINWSTIFEDTAIFKEKLRDIKWLSADQIRRLSSRPRYRGWGRFSAKLLCGLHDRQGNTVMDELWQTSRNFMQIIRQSDFQTAIAAVNQQDLGRQDLQRVIDDLYTSPQNKKAIRQVLAVVTDIQKAMHGKAPSWLFVEVAKGAQKNPQRTQSRQSKLAEAYRESARELVDEAVKEQLLTLPDDRQTFSDRLVLYFQQNGRDIYTGEPLDFERLSNYHIDHIIPQAVVKDDSLDNRVLTSNQANLEKGAHVPTIFRDKQEPVWQELYRVGLISHRKLRNLLTTPDDLDDRGRATGFIARQLVETRQVIKLVMEVLSQYYDTTETELISIKAGLSHQFRQELNLPKLRALNDYHHAQDAYLAARIGTYLLQRYPNLKRFFVYGDFKKTHFDLQRRFNFIGGMISREKQPYNLIKNPVTHQVIWDEEMEIGDCQKKNPEQPKHDATVKMMNLTKIMNLKHILVTHEVYENHGALFNQTIYPASQAHKKKLIPQKTEKPIELYGGHSSEQAGYMAIIRLLGKRPGYKVMRVPVRYVSQLQHQDVAEQKKLLYKIFVSELTSRNKVKPFEVVVPHVCLNQPVEDMIKGQWHRFALRTNGYYQNQQQLILSLVAQRTLAGYKPKDDELMAVYHEICKQVKYYFPLYKMNKFQSRLFAAEELLQKRSTVNSFSITIGKNGKENKTLNLGKRELLLRLLGGLHANATRVDLKDIGCTGQFGQLQVKNGIKLTEQAVLIHESPTGLFHRRVRLNDL

SEQ ID NO: 1073 - protein, 1377 aa, Artificial Sequence
  Cas9
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKADEIKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYNEDLEELLGKIGDDYADLFTSAKNLYDAILLSGILTVDDNSTKAPLSASMIKRYAEHHEDLEKLKEFIKANKSELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDVHKLIAKSSDDHSEMGKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 1074 - protein, 1377 aa, Artificial Sequence
  Cas9
MKKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPGLDSNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLKRYILKSKASNTIDKATEKYFFYSNLLNFFKEKVRYADGTIKKRENIEYSNDTGEIAWNKEKDFATIKKVLSLPQVNIVKKTEEQTVGQNGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 1075 - protein, 1377 aa, Artificial Sequence
  Cas9
MNNKPYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLEEKAPLQFSKDTYDEDLENLLEQIGDDFADLFVAAKKLYDAILLSGILTVTDPSTKAPLSASMIERYENHQKDLAVLKQFIKTNLPEKYVEVFSDQSKDGYAGYIDGKTTQEAFYKYIKNLLSKFDGADYFLDKIEREVFLRKQRTFDNGSIPHQIHLQEMNTILRRQGEHYPFLKENKEKIEKILTFRIPYHVGPLARGNRDFAWLTRNSDQAIRPWNFEEIVDKASSAEDFINKMTNYDLYLPEEKVLPKHSLLYETFAVYNELTKVKFIAEGMRDYQFLDSGQKKKIINQLFKKKRKVTEDDIIDCLQKIDNYDGIELKGIEKQFNASLSTYHDILKIIRDKEFMDDPKNGDILENVIHTLTIFEDREMIKQRLAQYNSIFDEKVIKALSRKHYTGWGKLSAKLIDGIRDKQTGKTILDYLMDDGKSNRNFMQLIKDDELSFTEIIQKAQVVGDTDNLRQVVQNLPGSPAIKKGILQSIKIVDELVKVMGHAPESIVIEMARENQTTARGKKNSQQRYKRIEDSLKNLASGLDSNILKENPTDNIQLQNDRLFLYYLQNGKDMYTGEALNINQLSSYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNKEVTEKNKKNRNVKIITLKSNMVSNFRKEFGLYKVREINDYHHAHDAYLNAVVAKAILKKYPKLEPEFVYGDYQKYDLKRYISRSKDPKEVEKATEKYFFYSNLLNFFKEEVHYADGTIVKRENIEYSKDTGEIAWNKEKDFATIKKVLSLPQVNIVKKTEEQTVGQNGGLFDNNIVSKKKVVDASKLIPIKSGLSPEKYGGYARPTIAYSVLVTYKQNNKIKNTMVGIPVLTKLEFERDPNLYLRNLGINNVSHVIKLVKYTVLEFKHKYGTYRRFIVSNQELKRANQIFVTTKQMKLISQYTTLDKNEHDSLLKNNQQLIQSIWNQFLEFMLATDLVNKKQYDELILTNNQTIEECRNIMNRVITTLSFTNINAGQKKIIFDDTLSLPIKRWQFTDSDKMVKKIIESTLIHQSITGLYETRIDLSKLGED

SEQ ID NO: 1076 - protein, 1377 aa, Artificial Sequence
  Cas9
MESNHDGEQVKYTLGLDIGTSSIGYAAIDKHQKPIRAKGKHVIGVRLFQEGQTAADRRAFRTTRRRLKRRKWRLNLLNRLFDPYLSEVDPNFLPRLRQSNLSPKDDNKHFNGSTLFPDKTDAAFYRQYPTMYHLRYALMTEKRKFDIREVYLAIHHIVKYRGNFLNSATVDSFKTSNIDFTSQFDRLNELYRQVILDEPFQINMDQVDEMTNKLLDNDALKLDTQKQVAKLLPVIYNDKPIDKQYTRIATEFSKAILGYKTKLDVILNLDTQNAKDWVIRLDDEDIDDKLPALVENLDESRQEIVTIIRDLYAQITLNAIVPKGKSLSESMVDKYNDHKDHLDLLMGLIHELGDDSAKGIKLREAYTQYVGKSDDKTLNQDDFYAAIKKNLDEDSKRSPKIQRLIEQASFMPKQRTSANGVIPHQLHQLELDRIIENQGRYYPFLKKPNPNTHKPNGGKYKLDELVAFRIPYYVGPLITKRDQEKTSGADFAWMIRKPGQEGEITPWNFDQKVDRMASANRFIRRMTTKDSYLVAEDVLPDASLIYEKFKALNELNMLKVNDSRLSPSQKQDLFNNLFKKQKTIRTKKLQTYIRTNWELPSVMISGLADPDKFNSSLSTYIDFRDIFGEKVDDPNRQADYEEIIEWSTVFEDRKIYQAKLNQLDWLTEPQRKALLTKRYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSLENNPQRTVSRQRQLQAAYKNIPREIMKSGLMAELGSVADSKKVLSDKLYLYFTQMGKDMYEDKTINIDNLPNYDIDHILPQAFIKDDSIDNRVLISKEENARKSNRVPLKFFGAKRMGFWKDLLNNGLISNRKFQNLTTDPEKISKYSAKGFIHRQLVETSQVIRLVANILGNEYSQAGTTIIEVSAKMNRQLREDFHLIKNRNVNDYHHAMDAYLTAYVGDYLYLRYPKLRPYFVYGDFKKAEDQDLNIRNFNFLHDLKDNESLDKIVDSETGEIVWEKHGSVKQLKKVYHYKFMLVSQEVYTRQDALFNQTIYPASDADKRKLIPIKNSKPVDVYGGYSGNIDAYMAIVRVHGKKEDNYKVVGIPMRAVTKLKKAEKEGHDSYLNAVHEVLKPQFTKKKKNRKTGEITETVDEFDVLLGKVYYRQLIVDGNKKFMLGSSSYQYNAKQLVLSDKAMQVLSKNGKVKSQDENQNLIDVYDEILEKVDQYFELYDQRHYRESLHKGRGIFVNLPLSNQYDGSKLTSYGKYETIDAILNGLHANATMSNLRYLGISSPFGKMQASNGLTIDPDSIICYQSPTGLFERQIKLSDL

SEQ ID NO: 1077 - protein, 1377 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMRKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 1078 - protein, 1377 aa, Artificial Sequence
  Cas9
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 1079 - protein, 1378 aa, Artificial Sequence
  Cas9
MKTFAEEYVMDKSKPYGIGLDIGTNSVGFVATDAEGHLIRLKGKTVIGAYLFNAGISAAERRGFRTTRRRLSRVKWRLGLLREIFETHFQESMGENEDNDFFLRFKYSNISPKDPQFSTAKGLFNDRTDKEFYDQYPTIYHLRRALMTEDHQFDIREIYIAMHHIVKYRGHFLKEGRAKDFKVGDLRLLDNFKMMNEQIEEINPLWQLKLPTDDASIKSITAILLDNTQSQNDRQKAVTKVILATLVKASDKDINAARKRFVGELSKAMVGLKTKLWVLADVSQNGDWEIKYENYADFAETIGSGESDTIQSLFNEINDLYGVITLAGIIPKEAESFSDGMVRKYEHHRKNLELLKVYCAEQSDGKRGRQIRQTYDKYIDGVDSKQFTQEDFYKALSKFTAKDEATSENAKLIAQEIAVGTFMPKLRTKANGTIPHQLHQKELDAIIENQKKYYPWLGEVNPVESHRRALPYKLDELVSFRIPYYVGPMVTPTKGDPEKSKFAWMVRKEPGTITPWNFDQKVDRSASGEAFIQRMKTTDTFLIGEDVLPQQSLLYQKFEVLNELNKIMINGKPICREQKQRLFKQLFMQYKTVTVKKVQQNLIANGEESENVPITGLSDPLRFNSSFSTYIDYKDILGTAAVNDNAKQSDIEQIIAWSTIFEDAAIFREKLNDITWLNDDQRNKLSHKRYRGWGRHSRKLLAGLRDGEGQTIIERLWNTNDNFMQIQNDSEIARQITEANSSKMATAEGTDEIIDGFYTSPENKKALREVMKVVKDIQRAHHGQAPAWVYIESPRETPRPGQRTVSREQQLTDLYEGAAKEIVDDAVLNELKDKVKSKENFTDKLVLYFLQNGHDIYANDSINIDNLNAYDIDHVLPQSLIKDDSLDNRVLTTHERNLKKSNRFATELFADQRKKWEKWHRLGLISSRKLKHLTMQPNSVEKFAHGFIARQLTETRQIIHLTANVLSNLYQENDTKIVMIKAGLNSEFRRTFDFPKNRSVNDYHHAFDAFLTAKIGRYLLARYPKLEPFFVYGNFVKNPKAMKRLSSFDFIAQLAAKTDDTSHIDQRSLKQVPVVNEETGEIVWDKDIELAELDKTYNYKTMLVKRAQTENNAQMFKQTVFKARDNQNKTLIPVKNGLSTDVYGGHSQQAISYLCIVWVGQKKKYRVLGISTAHAGILNNFEKNYGRFEAKKKLQEIVSNTLDNADRNDFKIVAPKVLFEQVVEDDNMKFGLGSASDYRNVQQLFLSRKNQLLLANMMTDQIHDQDLVHLFDEIVGQMNAHFPIFDRGGYRSSLTQSRDKFLKLPFKKNEDLITKQEVIRRILDGLHANANRKDLKIIGSKGDFGRLGTKKIYLSKDAKLIYTSPTCLFTRTVPLSSL

SEQ ID NO: 1080 - protein, 1378 aa, Artificial Sequence
  Cas9
MTNEKYSIGLDIGTSSIGFAVVNDNNRVIRVKGKNAIGVRLFDEGKAAADRRSFRTTRRRLSRRRWRLKLLREIFDAYITPVDEAFFIRLKESNLSPKDSKKQYSGDILFNDRSDKDFYEKYPTIYHLRNALMTEHRKFDVREIYLAIHHIMKFRGHFLNATPANNFKVGRLNLEEKFEELNDIYQRVFPDESIEFRTDNLEQIKEVLLDNKRSRADRQRTLVSDIYQSSEDKDIEKRNKAVATEILKASLGNKAKLNVITNVEVDKEAAKEWSITFDSESIDDDLAKIEGQMTDDGHEIIEVLRSLYSGITLSAIVPENHTLSQSMVAKYDLHKDHLKLFKKLINGMTDTKKAKNLRAAYDGYIDGVKGKVLPQEDFYKQVQVNLDDSAEANEIQTYIDQDIFMPKQRTKANGSIPHQLQQQELDQIIENQKAYYPWLAELNPNPDKKRQQLAKYKLDELVTFRVPYYVGPMITAKDQKNQSGAEFAWMIRKEPGNITPWNFDQKVDRMATANQFIKRMTTTDTYLLGEDVLPAQSLLYQKFEVLNELNKIRIDHKPISIEQKQQIFNDLFKQFKNVTIKHLQDYLVSQGQYSKRPLIEGLADEKRFNSSLSTYSDLCGIFGAKLVEENDRQEDLEKIIEWSTIFEDKKIYRAKLNDLTWLTDDQKEKLATKRYQGWGRLSRKLLVGLKNSEHRNIMDILWITNENFMQIQAEPDFAKLVTDANKGMLEKTDSQDVINDLYTSPQNKKAIRQILLVVHDIQNAMHGQAPAKIHVEFARGEERNPRRSVQRQRQVEAAYEKVSNELVSAKVRQEFKEAINNKRDFKDRLLLYFMQGGIDIYTGKQLNIDQLSSYQIDHILPQAFVKDDSLTNRVLTNENQVKADSVPIDIFGKKMLSVWGRMKDQGLISKGKYRNLTMNPENISAHTENGFINRQLVETRQVIKLAVNILADEYGDSTQIISVKADLSHQMREDFELLKNRDVNDYHHAFDAYLAAFIGNYLLKRYPKLESYFVYGDFKKFTQKETKMRRFNFIYDLKHCDQVVNKETGEILWTKDEDIKYIRHLFAYKKILVSHEVREKRGALYNQTIYKAKDDKGSGQGSKKLIRIKDDKETKIYGGYSGKSLAYMTIVQITKKNKVSYRVIGIPTLALARLNKLENDSTENNGELYKIIKPQFTHYKVDKKNGEIIETTDDFKIVVSKVRFQQLIDDAGQFFMLASDTYKNNAQQLVISNNALKAINNTNITDCPRDDLERLDNLRLDSAFDEIVKKMDKYFSAYDANNFREKIRNSNLIFYQLPVEDQWENNKITELGKRTVLTRILQGLHANATTTDMSIFKIKTPFGQLRQRSGISLSENAQLIYQSPTGLFERRVQLNKIK

SEQ ID NO: 1081 - protein, 1378 aa, Artificial Sequence
  Cas9
MKNKDYSIGLDIGTSSIGFAVVDENNHVMRVKGKNAIGVRLFDEGKPAADRRAFRTTRRRLSRRRWRLKLLREIFDSYITPVDEAFFIRLKESNLSPKDSKKQYSGDILFNDRSDKDFYTKYPTIYHLRNALMTEHQRFDIREIYLAIHHIVKFRGHFLNATPANNFQVGKLDLDQKFEDLNDIYQRVFPDDSIEFRIDNLEQIKAVLLDSKRSRSDRQRSLVDDVYQTSEDKEVEKQNKAVATEVLKAILGNKAKLNIIANVEVDKEAAKEWTITFDSESIDDDLAKIDGQMTDDGRAIVEILRSLYSGITLSAIVPENHTLSQAMVAKYDLHKKHLTLLKKLINSMTDTKKAKNLRAAYDGYVDGVKGKVLTQDEFYKQIQSNLDESVEASEIQTYIDQDIFMPKQRTKANGSIPHQLQQQELDQIIENQKEYYPWLAELNPNPDKKRQQLAKYKLDELVTFRVPYYVGPMITAEAQKKQSGAEFAWMIRKESGNITPWNFDQKVDRMATANQFIKRMTTTDTYLLGEDVLPSQSLLYQRFEVLNELNKIRIDRKPISVELKQQIFNDLFKKFKNVTIKHLQDYLVAQGQYSKRPLIEGLADEKRFNSGLSTYNDFCGIFGAKLVDENDRQADLEKIIEWSTIFEDKKIYRAKLNDLAWLTDEQKDKLATKRYQGWGRLSSKLLIGLQNSEHRNIMDLLWIGNENFMQIQADSDFAKLIKDANQNALQNNDSQDVINDLYTSPQNKKAIRQILLVVHDIQNAMHGQAPTKIHVEFAKGEERNPRRSVQRQRQVEAAYEKASNELVGANVREELKDAITNKRDFKDRLFLYFMQGGVDMYSGEPINIDNLSRYDIDHILPQAFVKDDSLNNRVLTDAEKNRRKSDAVPNELFGAKMRVTWERMKEQGLISKGKYRNLTMNPENINKYTENGFINRQLVETRQVIKLAVNILADEYKENTQIISVKADLSHQMREDFELLKNRDVNDYHHAFDAYLAAFMGNYLLKRYPKLRSYFVYGDFKKFTQKEIKLRRFNFIYDLKHEDQVIDKETGEILWNKNEDIAYIRHLFAYKKILISHEVSERRGALYNQTVYKASDDKASGQGSKKLIPIKSDKPTEIYGGYTGRTLAYMTIVKVTKGKKISYKVVGVPTAVLAKMAGVRQGSQEEQDKLYGVLKPQFTHQKENKKTGEITETVDKFDIIVPKVKYQQLVNDNGQLFMIGSDTLPYNAEQLVLSKESVQTINNPGIKDEGSDEESENKKLDNVYDEIVLCMNKYFPLYDNRGFRNSITNGKNKFLKLPIKNIYKNGKLINVGKREVINRILQGLHANASVTDLSNLGIKSPFGFLQKGAGLSLSGEAQLIHQSATGLFEHRVQLNKIK

SEQ ID NO: 1082 - protein, 1378 aa, Artificial Sequence
  Cas9
MSNKPYSIGLDIGTNSVGWAVITDDYKVPSKKMKVLGNTDKHFIKKNLIGALLFDEGTTAEGRRLKRTARRRYTRRKNRLRYLQEIFSEEISKVDSSFFHRLDDSFLVPEDKRGSKYPIFATLAEEKEYHKNFPTIYHLRKQLADSKEKADLRLIYLALAHMMKYRGHFLYEESFDIKNNDIQKIFNEFISIYDNTFEGSSLSEQNVQVEAIFTDKISKSAKRERVLKLFPDEKSTGLFSEFLKLIVGNQAEFKKHFDLEEKAPLQFSKDTYDEDLENLLGQIGDGFADLFLVAKKLYDAILLSGILTVTDPSTKAPLSASMIERYENHQKDLASLKQFIKNNLPAEKCVEVFSDQSKDGYAGYIDGKTTQEAFYKYIKNLLSKLEGAYYFLDKIEREDFLRKQRTFDNGSIPHQIHLQEMNAILRRQGEHYPFLKENREKIEKILTFRIPYHVGPLARGNRDFAWLTRNSDEAIRPWNFEEIVDQASSAEDFINKMTNYDLYLPEEKVLPKHSLLYETFAVYNELTKVKFIAEGLTRYQFLDKKQKKDIFYTFFKAEDKRKVTEKDIIHYLHNVDGYDGIELKGIEKQFNASLSTYHDLLKIIKDKEFMDDPKNEEILENIVHTLTIFEDREMIKQRLAQYDSLFDEKVIKALTRRHYTGWGKLSAKLINGICDKQTGKTILDYLIDDGKINRNFMQLINDDGLSFKEIIQKAQVVGKTYDVKQVVQELPGSPAIKKGILQSVKLVDELVKVMGHAPESIVIEMARENQTTAKGKKNSQQRYKRIEDAIKNLAPGLDSTILKEHPTDNIQLQNDRLFLYYLQNGRDMYTGKPLEINQLSNYDIDHIIPQAFIKDDSLDNRVLTSSKENRGKSDNVPSLEVVEKMKAFWQQLLDSKLISERKFNNLTKAERGGLDELDKVGFIKRQLVETRQITKHVAQILDARFNKEVTEKNKKNRNVKIITLKSNMVSNFRKEFGLYKVREINDYHHAHDAYLNAVVAKAILKKYPKLEPEFVYGDYQKYDLKRYISKSKDPKEVEKATEKYFFYSNLLNFFKEEVHYADGTIVKRENIEYSKDTGEIAWNKEKDFATIKKVLSFPQVNIVKKTEEQTVGQNGGLFDNNIVSKEKVVDASKLIPIKSGLSPEKYGGYARPTIAYSVLVTYKQNNKIKNTMVGIPVLTKLEFERDPNLYLRNLGINNVSHVIKLVKHTVLEFKHKYGTYRRFIVSNQELKRANQIFVTTKQMKLISQYTTLDKNEHDSLLKNNQQLIQSIWNQFLEFMLATDLVNKKQYDELILTNNQTIEECRNIMNRVITTLSFTNINAGQKKIIFDDTLSLPIKRWQFTDSDKMVKKIIESTLIHQSITGLYETRIDLNKLGED

SEQ ID NO: 1083 - protein, 1378 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHHEDLKHLKQFVKASLPENYREVFADSSKDGYAGYIEGKTSQEAFYKYLLKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIIQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLGNLKSNILEEKKPKYVKDQVENHHLSDDRLFLYYLQNGKDMYTDDELDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGLYRRKKLSKIVREDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNTSAFLESKGYLNIRDDKLMILPKYSLFELENGRRRLLASAGELQKGNELALPTQFMKFLYLASRYNESKGKPEEIEKKQEFVNQHVSYFDDILQLINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 1084 - protein, 1378 aa, Artificial Sequence
  Cas9
MTNEKYSIGLDIGTSSIGFAVVNDNNRVIRVKGKNAIGVRLFDEGKAAADRRSFRTTRRRLSRRRWRLKLLREIFDAYITPVDEAFFIRLKESNLSPKDSKKQYSGDILFNDRSDKDFYEKYPTIYHLRNALMTEHRKFDVREIYLAIHHIMKFRGHFLNATPANNFKVGRLNLEEKFEELNDIYQRVFPDESIEFRTDNLEQIKEVLLDNKRSRADRQRTLVSDIYQSSEDKDIEKRNKAVATEILKASLGNKAKLNVITNVEVDKEAAKEWSITFDSESIDDDLAKIEGQMTDDGHEIIEVLRSLYSGITLSAIVPENHTLSQSMVAKYDLHKDHLKLFKKLINGMTDTKKAKNLRAAYDGYIDGVKGKVLPQEDFYKQVQVNLDDSAEANEIQTYIDQDIFMPKQRTKANGSIPHQLQQQELDQIIENQKAYYPWLAELNPNPDKKRQQLAKYKLDELVTFRVPYYVGPMITAKDQKNQSGAEFAWMIRKEPGNITPWNFDQKVDRMATANQFIKRMTTTDTYLLGEDVLPAQSLLYQKFEVLNELNKIRIDHKPISIEQKQQIFNDLFKQFKNVTIKHLQDYLVSQGQYSKRPLIEGLADEKRFNSSLSTYSDLCGIFGAKLVEENDRQEDLEKIIEWSTIFEDKKIYRAKLNDLTWLTDDQKEKLATKRYQGWGRLSRKLLVGLKNSEHRNIMDILWITNENFMQIQAEPDFAKLVTDANKGMLEKTDSQDVINDLYTSPQNKKAIRQILLVVHDIQNAMHGQAPAKIHVEFARGEERNPRRSVQRQRQVEAAYEKVSNELVSAKVRQEFKEAINNKRDFKDRLFLYFMQGGIDIYTGKQLNIDQLSSYQIDHILPQAFVKDDSLTNRVLTNENQVKADSVPIDIFGKKMLSVWGRMKDQGLISKGKYRNLTMNPENISAHTENGFINRQLVETRQVIKLAVNILADEYGDSTQIISVKADLSHQMREDFELLKNRDVNDYHHAFDAYLAAFIGNYLLKRYPKLESYFVYGDFKKFTQKETKMRRFNFIYDLKHCDQVVNKETGEILWTKDEDIKYIRHSFAYKKILVSHEVREKRGALYNQTIYKAKDDKGSGQGSKKLIRIKDDKETKIYGGYSGKSLAYMTIVQITKKNKVSYRVIGIPTLALARLNKLENDSTENNGELYKIIKPQFTHYKVDKKNGEIIETTDDFKIVVSKVRFQQLIDDAGQFFMLASDTYKNNAQQLVISNNALKAINNTNITDCPRDDLERLDNLRLDSAFDEIVKKMDKYFSAYDANNFREKIRNSNLIFYQLPVEDQWENNKITELGKRTVLTRILQGLHANATTTDMSIFKIKTPFGQLRQRSGISLSENAQLIYQSPTGLFERRVQLNKIK

SEQ ID NO: 1085 - protein, 1378 aa, Artificial Sequence
  Cas9
MTNEKYSIGLDIGTSSIGFAVVNDNNRVIRVKGKNAIGVRLFDEGKAAADRRSFRTTRRRLSRRRWRLKLLREIFDAYITPVDEAFFIRLKESNLSPKDSKKQYSGDILFNDRSDKDFYEKYPTIYHLRNALMTEHRKFDVREIYLAIHHIMKFRGHFLNATPANNFKVGRLNLEEKFEELNDIYQRVFPDESIEFRTDNLEQIKEVLLDNKRSRADRQRTLVSDIYQSSEDKDIEKRNKAVATEILKASLGNKAKLNVITNVEVDKEAAKEWSITFDSESIDDDLAKIEGQMTDDGHEIIEVLRSLYSGITLSAIVPENHTLSQSMVAKYDLHKDHLKLFKKLINGMTDTKKAKNLRAAYDGYIDGVKGKVLPQEDFYKQVQVNLDDSAEANEIQTYIDQDIFMPKQRTKANGSIPHQLQQQELDQIIENQKAYYPWLAELNPNPDKKRQQLAKYKLDELVTFRVPYYVGPMITAKDQKNQSGAEFAWMIRKEPGNITPWNFDQKVDRMATANQFIKRMTTTDTYLLGEDVLPAQSLLYQKFEVLNELNKIRIDHKPISIEQKQQIFNDLFKQFKNVTIKHLQDYLVSQGQYSKRPLIEGLADEKRFNSSLSTYSDLCGIFGAKLVEENDRQEDLEKIIEWSTIFEDKKIYRAKLNDLTWLTDDQKEKLATKRYQGWGRLSRKLLVGLKNSEHRNIMDILWITNENFMQIQAEPDFAKLVTDANKGMLEKTDSQDVINDLYTSPQNKKAIRQILLVVHDIQNAMHGQAPAKIHVEFARGEERNPRRSVQRQRQVEAAYEKVSNELVSAKVRQEFKEAINNKRDFKDRLFLYFMQGGIDIYTGKQLNIDQLSSYQIDHILPQAFVKDDSLTNRVLTNENQVKADSVPIDIFGKKMLSVWGRMKDQGLISKGKYRNLTMNPENISAHTENGFINRQLVETRQVIKLAVNILADEYGDSTQIISVKADLSHQMREDFELLKNRDVNDYHHAFDAYLAAFIGNYLLKRYPKLESYFVYGDFKKFTQKETKMRRFNFIYDLKHCDQVVNKETGEILWTKDEDIKYIRHLFAYKKILVSHEVREKRGALYNQTIYKAKDDKGSGQGSKKLIRIKDDKETKIYGGYSGKSLAYMTIVQITKKNKVSYRVIGIPTLALARLNKLENDSTENNGELYKIIKPQFTHYKVDKKNGEIIETTDDFKIVVSKVRFQQLIDDAGQFFMLASDTYKNNAQQLVISNNALKAINNTNITDCPRDDLERLDNLRLDSAFDEIVKKMDKYFSAYDANNFREKIRNSNLIFYQLPVEDQWENNKITELGKRTVLTRILQGLHANATTTDMSIFKIKTPFGQLRQRSGISLSENAQLIYQSPTGLFERRVQLNKIK

SEQ ID NO: 1086 - protein, 1379 aa, Artificial Sequence
  Cas9
MKQILGLDLGTTSIGWALVREAENKDEQSSIVRIGVRVNPLTSDEQKNFEQGKSITTNADRTLKRSMRRNLQRYKLRRDHLKDCLQKNGIITDKAVLSENGNYTTFQTYYLRAKAVNEKISLEEFARVLLMLNKKRGYKSSRKMKSADEGQLIDGMSVAKRLYNDNITPGQYVLSLLEEGRKYIPDFYRSDLLDELDKIWTFQQCFYPEILTPECRKLIAGKGKQATAKIFLGKYKIYTADNKSKDKRLQAYQWRVEALSGQLPIEVVAFVVCEINGAIQASSGYLGAISDRSKELYFEGLTVGQYLVKQLEKNPDTSLKNKVFYRQDYLNEFEKIWEKQAEYHTELTPQLKKEVRDIIIFYQRTLKSQKGLVGFCEFESRQIEVMIDGKLKKKTVGCRVCPKSSPLFQEYKIWHNLNNLKIVEKELGKSRFLNQDEKESLFQELNIKEKLSKTDILKLLCLKAKEFDLNFEKVEGNRTQAELFRAYQAIIEMSGNGDYDFSKMTSSEIQDTVTGVFRGLGYNTDILSFDAEKEEKTFDKQPMYLLWHLLYSYEGDSSDTGNKALITKIKKLCGFESEEYARILTDVTFQSEYGNLSTKAIRRILPFMKKGSEYSEACRHAGYRHSERSLTKEELDKKVYKDHLELLPRNSLRNPVVEKILNQMIHVVNTVVDTYGKPDEIRIELARELKKSAKERDEMTASINKTAAEHKKYCEVLQKEFGFTHVSRNDIIRYKLYLELENNGYKTLYSDTYIPREKLFSKEFDIEHIIPQSKLFDDSFSNKTLECRSVNIEKSNDTAYDYVLNKYGEQGILDYKNRIENLYKDSKISRTKYQKLMMKNSDISGNFIERELRDSQYIAKKAREILEELVKFVVPTTGSVTARLREDWQLVDVMQELNWKKYDKLGLTDVRYDKDGREIRYIKDWSKRNDHRHHAMDALTIAFTKRSIIQYLNNLNAKSDKSGSIYAIEQKELFRDKRGKLKFIPPMPCNIFRAEAKRHLENVLVSVKAKNKVVTPNINRSKGKNGINKKIQLTPRGQLHNETIYGSMKRYETKWEKIGSGFDERQIAKVANKKFREALLSRLAEFGNDPQKAFTGKNSLEKNPLYVDELHTQKVPEKVKIVTLENLYTIRKEITPDLKIDKVVDAGVRRVLQERLDEFDDDSKKAFSNLDENPIWLNGKKMKRVTIMGVSNAVPLHDKKDYKGNLVFDSKGRKQPVDFVNTGSNHHVAIYRDESGELQDIVVSFYEATTRSTLGIPVIDKEYKKAEGWNFLFSMKQNEYFVFPNEETGFNPKEIDLMNPDNYTTISPNLYRVQKFSKCMYGNSSVREYVFRHHLETSVNDSKGLKNIAYKNVKSLVYLEGIVKVRINHIGQIVSVGEY

SEQ ID NO: 1087 - protein, 1379 aa, Artificial Sequence
  Cas9
MRIDNGLEELKVNNRIYNIGLDIGTSSVGFAVTDAQDKLVRVKGKTAIGVRLFEEGHTAAERRGFRTTRRRLSRRKWRINLLNQIFEPYISEIDPTFFARLKNSSLAGKDKKFEGSLLFPDRTDYQFYKDNPTMYHLRKHLMEKDRQFDLREIYLAMHHIIKYRGNFLNTTPMNHFKNEEIDFSALFSRLNELYQEIDDENIFELNIENVDEIKKILLNHDLFKMEKQKQVAKLLNVDTDDKQLKKENTALASNFSKAILGYKFNLALVTKIPDQDKKEWTISLGDEDFDDRLDNVPVALTESQLEVVEVLHSIFNSISLNEIVENGETLSSAMVRKYNDHKHDLKLLKNVMTTLEDRKKAKKIQGIYNVFVGKDTDLISDKDKNKYKDKDEFYKEIQKNLDNSSDAEEIIKRIKQDQFLPKQRTSKNGVIPHQLHQRELDLIIENQAKYYPFLKEANPNKKRLKQAKYKLDELIAFKIPYYIGPTSGAENSDFSWLKRKKDGQITPWNFDEKVDRIESANRFIRRMTTKDTYLLAEDVLPLESLIYEKYSVLNELNNVRINRQKLSVNDKQDIYNELFKNSKTVTLKQLQKYFEVTKKLKTVVVEGLADPKKFLSNLGTYHDFKLIFGDIVDDPEYQTDLENIIEWSTIFEDRGIFNSKLNEITWLTDEQRKKVLSKRYQGWGRFSKKLLVGLKNSQGNSILDELWNTNLNFMQLQSQDDFAELIHAENAKQFKANDPDNPWNGIDAILNDAYTSPQNKKAIRQVVKVVQDIEKAMGNKPQKIAIEFTRSADKNPRRTDSRIKRLSDIYKEAAEKVVGESLKLELNEYLTSKKKMTDKMYLYFTQLGTDIYTGKKIDIDQLNNYDIDHVLPQSFLKDDSLDNRVLTNRSDNSEKSDTVPLHKFGAKMGNFWRQLADEGLITKRKYKNLTTDPATIDKYTIQGFIRRQLVETSQVIKLTANILGGLYPEETEILEIPAKLNHQFRDMFDLVKVREVNDYHHAFDAYITVFVGNFLYRRYPKLRSYFVYGDFKKLNKTDDDIRKFNFLNLFNKDKVEDNETDEILWSKAESIRDIKNIYNYKFMLVSREVYTRHGAMFNQTIYPASKNDSKKLIPIKKGKDTAIYGGYSGNTDAYMAIVAVEDKKGEKFKVVGVPTRAVSRLEQLAADDHDQYLTALHDVLKPNFTKIKTNRKTKAKEEVTTPFRILVGKVGYRQLIQDGQVKMMLGSSAYKYNAKQLVLSEKSLKVIKNNKKYNPDDENQDLIDVYDEILGVVNRAFNLYDTNGFRKKLNDNRVKFVELPINNIFDGTKLVQMGKRAVLTQILNGLHANAALGDLKALGISTPFGKMQSKSGIPLSMDASLVYQSPTGLFERKLNLSDL

SEQ ID NO: 1088 - protein, 1379 aa, Artificial Sequence
  Cas9
MTKKNYSIGLDIGTNSVGWAVITDDYKVPAKKMKVLGNTDKKYIKKNLLGALLFDSGETAEATRLKRTARRRYTRRKNRLRYLQEIFADEMAKVDESFFQRLDESFLRWDDDNKKLGRYPIFGNKADVVKYHQEFPTIYHLRKHLADSSEKADLRLVYLALAHMIKFRGHFLIEGELNAENTDVQKIFSDFVRVYDRTFDDSHLSEITVDAASILTEKISKSRRLENLIKYYPTEKKNTLFGNLIALALGLQPNFKMNFKLSEDAKLQFSKDSYNEDLEELLGKIGDDYADLFTSAKNLYDAILLSGILTVDDNSTKAPLSASMIKRYAEHHEDLEKLKEFIKANKSELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDVHKLIAKSSDDHSEMGKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 1089 - protein, 1380 aa, Artificial Sequence
  Cas9
MGKYNLGLDIGTNSVGWAVVDENNQIVKKGGKALWGVRMFDEAQSAKETRIYRNSRRRIVRRNQRLLLLQKEFYDEIIKVDQTFFQRLKDSFFKKEDKLNKNNYTFFDDDITDREYFKKFPTIYHLRSHLLYNDEKIDIRMLYLALHHIVKYRGHFLDSGEVNESNFSKIKDVLDTFNNKMSEMSLEFEDNEDYFCKIEFDENFENKLKDIMLSQLSKKEKRQELIDLFKVDKKSLVNELLIELLVNKKVKLNSLSITNGKKYEVCEIDFEKEELFEKLEDAKKIITELFDILDEIVNIKKIVDYYYVLKIIGDNEYLSEAMVKKYDKHDKDLRELKSFIKTYCPNKYYECFRKTSNPNLCNYPKYVGINSVNKKIERFAHCKKEEFYKYLKSLFNTIKDENAKLKIDLFQKDMENDDFLNRQNSNHNSSIPMQLNFCELKKILENQSKYYPFLMLKNSDGYSTSDRIIAIFKYKIPYYVGPLNKNSKYSWLVKKSNENITPWNYEKVIDLDASAKEFIQRMQNKCTYLKGENDYCLPKKSILFSEYNCLQYLNRLIINGALIENKLKNEIYENIFLCYKKPTKKSIVEYLKTNYNYDETTLKSNILEVNCDMSSYIQFKEIYGEDFEQNLNIVEDIIKDITIFEDKKILEKRLREIYHLSEDKVQKIKGLNYKGYATLSKHFLNNFYSVNEETGEIYGPIIQIMRDTNYNLQQVIYNDRYNFMKAIDKYNKKNLDTEKKLNVSDFIDEYIYVSPIMKRSLIQSYNIIQELEKILGESISKYYIECARVRSNSKDVINSRYRQLSELYKDCEHQVSDISKNYININKLKKQLEDNKNELRADKLYLYFTQFGKCMYTLKDIDLDDVFLGKYDIDHIYPQSLIKDDSLNNRVLASKEKNGKKDNQFIFNIPEFLPKNAELFYKKLLECKLITKEKYRRLTMKKIDDDELDIFVNRQLVATNQSVKGLVDVLKIYKGVKPTNIVYSKAVNISDFRNNYNLYKSRTANNYHHAHDAYLNVVIGKALDVYYQCNYFQNYKDVIKLKDRNITINPEIILSKNRYVNRNGEKKVIWDLDNTLKLIKNNLYNRFDITETIMTRKSNKMFSKSSISPAKNSKNLIPIKTSDPRCNVLKYGGIKSNSYNFYCIVELYDKKGKKSYILEAIPKTHSDKLEEYIKNSIDEKNVSNFKIINKNIKSNIIIEYKKLRYVITGKSGKYYLIKNFKDRNFSYNAIKTIKYIEKYNYQKKYEIPFEETKEKIILAPKKKDTKEISLTLDNCQALLDEIISLFKKDIYNYDIIYKITSKLEENKQNLTLTNLIKVLTEILILLKTNERGTADLTLIDMSKDTGTLCISKTLKPGMKFISESPTGYYRKIIFEVPNGI

SEQ ID NO: 1090 - protein, 1380 aa, Artificial Sequence
  Cas9
MKRILGLDLGTTSIGWALVNEAENNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKFQPLKWRVEALQQQVDKEVLAFVISDLKGQIANTSGLLGAISDRSKELYFNKQTVGQYLWASLEENPHISIKNKPFYRQDYLDEFEKIWETQAAFHKQLTPELKQEIRDIIIFYQRPLKSKKSLISVCELEQRKVKATIDGKEKEITIGPKVAPKSSPVFQEFRIWQNLNNVLLIDNDTNEKRPLDEVERNLLYKELSIKAKLSKTEALKILNKKGKQWDLNYRELEGNRTQAILFDCYNRIITLTGHEECDFKKIKASEIRHYVSTIFKNLGFSTEILDFDPSLKKHELEKQPMYQLWHLLYSYESDNSRTGNESLLRKLETTFGFPEEYATVLCDVVFEEDYGNLSVKAMREILPYLQAGNDYSQACAYAGYNHSRHSLTKEELDQKVYKERLELLPKNSLRNPVVEKILNQMINVINAIIDEYGKPDEIRIEMARELKSSAADRKKTTHAISQGNAENQRIREILEKEFSLSYISRNDIIKYKLYEELEPNYYKTLYSDTYITKDKLFSKDFDIEHIIPKARLFDDSFSNKTLEARNINLEKSNKTAFDFIKEKYGEDGAEAYKKKLDMLLENDAISRPKYNNLLRAEADIPSDFINRDLRNTQYIAKKACEILGELVKTVTPTTGKITNRLREDWQLVDVMKELNFEKYEKLGLTEIVEDRDGRKIKRIKDWTKRNDHRHHAMDALAIAFTKPSFIQYLNNLNARSNKGDSIYAIENKELHYEEGKLRFNAPIPVNEFRAEAKRHLSAILVSIKAKNKVMTQNVNKIKTKHGIIKKIQLTPRGPLHNETIYGTKMRPIIKMVKVGAALDEATINKVSSPAIREALLKRLNEYSGNAKKAFTGKNTLEKNPIYLNAGRTKTVPSLVKTVEWESFHPTRKLIDKDLNVDKVVDKGIREILKARLEEFNGDAKKAFSNLEENPIYLDEAKKIALKRVSIEGVLSAIPLHTLKNQAGKPITGKDGKPVLGNYVQTSNNHHIAFYYDEDGNLQDNAVSFFEAAERKSQGIPVIDKDYNRDKGWRFLFTMKQNEYFVFPNEATGFIPSEVDLTDEANYGIISPNLYRVQKVSRIDKGTSASRDYWFRHHLETILNDDAKLKNLAFKRIRGLLELKDIIKVRINSTGKIVAVGEYD

SEQ ID NO: 1091 - protein, 1380 aa, Artificial Sequence
  Cas9
MKKILGLDLGTTSIGWALVNEAETESEKSSIIRLGVRVNPLTIDEKGNFEKGKAITTNSDRQQRHSARINLQRYKLRRQNLCDCLQIGGLLGSESMYEEGKESTFETYKLRAKAATEKVALHEFARILFMLNKKRGYKSNRKANSKEDGQAFDGMTIAKKLYEENLTPAEYSLQLLNKGKKFSPSYYRSDLESELNRIWEEQKKYYPEILTDDFYQQLEGKTKVNTTKIFLAKYGIYTADLKGLDKKMQPLKWRIEALNKQVDKEVLTFVVSDLKGQIEKTSGLLGEISDRSKELYFNKQTVGQYVWASLKENPHVSIKNKPFYRQDYLDEFEKIWETQAAFHKELTPELKKEIRDIIIFYQRPLKSKKGLISICELEQKKEKVIIEGKEKEILIGSKVAPKSSPMYQEFRIWQNLNNVLLIDTEINESRPLDEEEKALLYNELSVRAKLSETEALKTINKKGKHWDLNFKELEGNRTQAVLFECYNRIITQTGHEECNFKKISAEDIRHYVATIFKNLGFNTDILDFNPSLEKHELEKQPMYQLWHLLYSYESDKSRTGNESLLNKLEANFGFPQEYASVLADATFEDDYGNISVKAIRKILPHLHDGYDYSEACERAGYNHSVRSLTKEELAQKVYKDRLDLLPKNSLRNPVVEKILNQMINVINAIIVEYGKPDEIRIEMARELKSSAAKREERTKSINQNAAENKRITEILQTEFGLSYISRNDIVKYKLYQELEANGFKTLYSNTYIPKEKLFSKDFDIEHIVPKARLFDDSFGNKTIEARDVNLAKSNKTAFDFVKEKYGEQGIEEYKKKLDTLLKENAISSGKYKKLMMSEADIPSDFINRDLRNTQYIARKAYEILGELVKTITPTTGKITDRLREDWQLIDVMKELNFEKYDRLGLTEVIEDRDGRKIKRIKDWTKRNDHRHHAMDALTIAFTKPSYIQYLNNLNARSDKSGSIYAIETKELHRENNTLRFNAPMPLNEFRKEAKRHLSAILVSIKAKNKVMTQNVNKIKTKNGIIKKVQLTPRGALHNETIYGTKMRPIIKMVKIGAALDEATINKVSSPTIREALLKRLNEYSGDAKKAFAGKNAITKNPIYLNAEHTKTAPAMVKIVEWEMYYPIRKLITPDLKIEKVIDNGIKEILKKRLKEFGGDAKKAFSNLDECPIYLDEEKNITLKRVSIEGVLSAIPVHTLKNHAGKEIKDEDGKAVLGDYVQTSNNHHVAIYQDAKGNLQDNVISFFEAAERKSQNVPIVDKNLNRDKGWHFLYTMKQNEYFVFPNEETGFVPSEIDLMDENNYEMISPNLFRVQTMSRVDYGKTIIREYVFRNHLETILNDNLKLKGLVFKKIKSLKALEGIVKVRVNAIGKIVAVGEYD

SEQ ID NO: 1092 - protein, 1380 aa, Artificial Sequence
  Cas9
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRHLENILHYFPNEKKNGLFGNFLALALGLQPNFKTNFELAEDAKIQFSKETYEEDLEELLGKIGDDYADLFIATKSLYDGILLAGILSTTNSTTKAPLSSSMVNRYEEHQKDLALLKNFIHQNLSDSYKEVFNDKLKDGYAGYIEGKTTQENFYRFIKKAIEKIDGSNYFIEKIEREDFLRKQRTFDNGSIPHQIHLREMQAIIRRQAKFYPFLEENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDRTFKVYRKVTKEKLMDFLSKEFDEFRIVDLLGLDKDNKSFNASLGTYHDLKKIVSEDFLDNSENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGKAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVYKKKNFWKQLLDSQLISQRKFDNLTKAERGGLTNEDKARFIQRQLVETRQITKHVARILDTRFNTKLDEAGNRIRDPKVNIMTLKSSLVSQFRKDYQLYKVREINNYHHAHDAYLNAVVATALLKKYPQLAPEFVYGDYPKYNSYKSRKSATEKVLFYSNIMNFFKRVLVYSKTGEVRIRPVIEVNKETGEIVWDKKSDFRTVRKVLSYPQVNVVKKTEVQNHGLDRGKPKGFYNANLSPRPKEGSVENLVPAKQSFDTKRYGGYAGISNSYAVLVNGIIEKGKKKSKAEVTEFQGISILARKDFDKNPKQYLLNLGYKDIKSIIKLPKYSLFELENGSRRMLASILSTNNKRGEIHKGNEMYLPDKFVTLLYHAMRVNRTLEPGHKKYVEAHRHVFDELLTYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 1093 - protein, 1380 aa, Artificial Sequence
  Cas9
MKKILGLDLGTTSIGWALVYESENADEKSSIVRLGVRVNPLSVDEKGNFEKGKSITTNADRQQTHGARINLQRYKLRRENLKDCLQKQGWIGTEALYEEGKTSTFETYMLRAKAAEEEISLHELCRVLFMLNKKRGYKSNRKANNKEDGKLFDGMTVAKKLYEEHLTPAEYSLKLLSSGKKFKQEYYRSDLKEEFDRIWNEQQKYYPEILTDDFKQQLQGKSKGNTSKIFLGKYGIYSADLKGLDRKLQPLKWRVEALKQKVDKEVLAFVISDLNGQIASTSGLLGAISDRSKELYFNKQTVGQYLWTSLKESPHVSIKNKPFYRQDYLDEFEKIWETQATYHKELTPELKQEIRDIIIFYQRPLKSKKGLISVCELEQRKVKVTIDGKEKEISIGPKVAPKSSPMFQEFRIWQNLNNILLIDKGNNSNRPLYEEERNLLYEELSVKEKLSKAEALKVLNKNGKQWDLNYKEIEGNRTQAVLYDCYNRIIGMTGHEECNFKKLKASDIRYNVKTIFKNLGFSTDILDFDSSLQGHELERQPSYQLWHLLYSYESDNSRTGNDALLRKLETAFSIPKEYAAVLSDVVFEDSYGNLSVKAMRNILPHLQAGLDYSQACEKAGYKHSRRSLTKNELDKKEYKEKLELLPKSSLHNPVVEKILNQMINVINAVIDEYGKPDEIRIELARELKIGAAERENMTRSINQGNAENKRIREILEKEFALSYISRNDIIKYKLYEELKSNGFKTLYSDTYISKDKLFSKDFDIEHIIPKARLFDDSLSNKTIEARDVNIAKSNKTAFDFISEKYDQQGIEAYKKKLDILLQDGSISKAKYNRLLMKEADIPSGFIDRDLRDTQYIAKKAYEILSDLVRNVTPTTGAVTSRLREDWQLVDVMKELNFEKYQKLGLVEVIEDRDGRKIKRIKDWTKRNDHRHHAMDALTIAFTKPSYIQYLNNLNARSDKNSSIYGIENKELHREDNKLRFNAPLPINEFRAEARRHLKSILVSVKAKNKVMTQNVNVIKTKHGVIKKVQLTPRGELHNATFYGTKKRPIIKMVKVGAALDEVTIKKVSSSFIREALLDRLHEYNGDAKKAFTGRNSIDKNPIYIDEEHKKTVPALVKTIEWEMYHPTRKMISPDLKIDKVIDKGIREILRTRLAKFNGDAQKAFSNLDENPIYKDEAKKITLKRVSLEGVSSVIPLHKLKDMGGKPVVGKDGKPVWGDYVQTSNNHHIAFYMDENGNLQDDVVTFFKAARRKSQGVPVIDKNYNHDKGWHFLFTMKQNEYFVFPNEATGFIPTEVDLMDEANYDMISPNLYRVQKMSKTKQGITDKRDYWFRHHLETVLNNDLKVRNSIFKQINSLKPLEGIVKVRINAIGKIVAIGEYD

SEQ ID NO: 1094 - protein, 1380 aa, Artificial Sequence
  Cas9
MKRILGLDLGTTSIGWALVNEAESNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKLQPLKWRVEALKQQVDKEVLAFVISDLKGQIANTSGLLGAISDRSKELYFNKQTVGQYLWASLEENPHISIKNKPFYRQDYLDEFEKIWETQATFHKQLTPELKQEIRDIIIFYQRPLKSKKSLISVCELEQRKVKATIDGKEKEITIGPKVAPKSSPVFQEFRIWQNLNNVLLIDNDTNEKRPLDEDERYLLYKELSIKAKLSKTEALKILNKKGKQWDLNYKELEGNRTQAILFDCYNRIITLTGHEECDFKKIKASEIRHYVSTIFKNLGFSTEILDFDPSLEKHELEKQPMYQLWHLLYSYESDNSRTGNESLLRKLETTFGFPEEYATVLCDVVFEEDYGNLSVKAMRKILPYLQAGNDYSQACAYAGYNHSRHSLTKEELDQKVYKERLELLPKNSLRNPVVEKILNQMINVINAIIDEYGKPDEIRIEMARELKSSAADRKKTTHAINQGNDENQCIREILEKEFALSYISRNDIIKYKLYEELKPNGFKTLYSDTYIPKDKLFSKDFDIEHIIPKARLFDDSYSNKTLEARDINLAKSNKTAFDFVKEKYGEQGAEAYKKKLDMLLGNNVISKPKYNKLLMTEADIPSDFINRDLRNTQYIARKACEILGELVRTVTPTTGKITNRLREDWQLVDVMKELNFEKYEKLGLTEIVEDRDGRKIKRIKDWTKRNDHRHHAMDALAIAFTKPSYIQYLNNLNARSNKGDSIYAIENKELHYEEGKLRFNAPIPVNVFRAEAKRHLSAILVSIKAKNKVMTQNVNKIKTKHGIIKKIQLTPRGPLHNETIYGTKMRPIIKKVKVGAALDEATINKVSSPAIREVLLKRLNEYSGNAKKAFTGKNTLDKNPIYLNAERTKTVPASVKTVEWENYHPIRKPITPDLKVDKVIDKGIGEILKARLEEFNGDAKKAFSNLEENPIYLDQTKKIALKRVSIEGVLSTIPLHTLKNQAGKPIMGKDGKPVLGNYVQTSNNHHIAFYYDEDGNLQDNAVSFFEAAERKSQGISVIDKDYNRDKGWRFLFTMKQNEYFVFPNEATGFIPSEVDLTDEANYGIISPNLYRVQKMSRIEKGTSVSRDYWFRHHLETILNDDSRLKNSAFKRINSLKPLEGIIKVRINSIGKIVAVGEYD

SEQ ID NO: 1095 - protein, 1380 aa, Artificial Sequence
  Cas9
MKKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLEEEKEYHKKFPTIYHLRKHLADSKEKADLRLIYLALAHMIKYRGHFLYEDTFDIKNNDIQKIFNEFISIYDNAFEGSSLSGQNAQVEAIFTDKISKSAKRERVLKLFPDEKSTGLFSEFLKLIVGNQADFKKHFDLEDKAPLQFSKDTYDEDLENLLGQIGDDFADLFVAAKKLYDAILLSGILTVTDPSTKAPLSASMIERYENHQNDLVVLKQFIKNNLPENYVEVFSDDSKNGYAGYVGVDSKIRKRNAKLATEEEFYKYLKNILNNVKGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEDFINKMTNYDLYLPEEKVLPKHSLLYEKFAVYNELTKVKFIAEGLRDYQFLDSGQKKQIVNQLFKEKRKVTEKDIIHYLHTVDGYDGIELKGIEKQFNASLSTYHDLLKIIKDKEFMDDPKNEEILENIVHTLTIFEDREMIKQRLAQYDSLFDEKVIKSLTRRHYTGWGKLSAMLINGIRDKQTGKTILDYLIDDAYYNRNFMQLINDDGLSFKEIIQKAQVVGKTDDVKQVVQELPGSPAIKKGILQSIKIVDELVKIMRHNPESIVIEMARENQTTARGKKNSQQRYKRIEDALKNLAPGLDSNILKEHPTDNVQLQNDRLFLYYLQNGKDMYTGEALDINQLSSYDIDHIIPQAFIKDDSFDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLKRYISRSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILWDTTKYGGFDSPVIAYSILLIADIEKGKAKKLKTVKTLVGITIMEKAAFEDNPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETRIDLSKLGED

SEQ ID NO: 1096 - protein, 1380 aa, Artificial Sequence
  Cas9
MNLRHVGNYNIGLDMGTASVGWAAIDEQGELLHFKGKPTWGSRLFDSANTAATARMPRGQRRRYIRRRWRLDLLQKFFSEEMAEKDPEFFIRLRQSSLWPEDREGGHTAYHWPLFNDSDFNEKEYYEKFPTIFHLRQWLMETDEKADIRLIYLAFHNIVKHRGNFLQENNDSLSAQNANMRESLESFCIALEEWCDEKELTCSCDPQKLEHLFKEVKYRSDIRDGFAALLGLACSGENEVDVKAMAKEMGKAIVGYKADFSKIFTECDKEGSSFRLSDDEGPEAFLDICPDDGIALFEAIQMVYSSFILTGMLTEKGLSLSKISAYNQYGQDLESLKALVKEYVPNEYSSFFRGPTYSGSTEYDPSKAQGYTRYNLGPSKKGSGAKPMAYEDFKKSVEQLFANTNAINDERYKEMMGRFAEEKFLRRLRTSDNGRIPFQLNLEEMTAIIINQGKYYPFLLEQQEKLESLVRFRIPYYVGPLTRINARLDSKGNACFAWSKRKDGMDSASIKPWNWDEVIDKHASAQAFIERMTGTCTYLRGEPVLPRCSLLYEEYCVLNELNGARWTQDGDKFIRFDYKDRSDIIEELFKKRRGRIQYAAVADWMKQERSHANVHVSGGQGENAFESRLSSYHFFCNDVFGVDELPGSYVDMVEEIILWSTLFEDRSILREEIQRKYGDVLNEEQIKTICKKRFSGWGRLSRKLLCSLKAQTDNGPKSIMDILQEGDQNNGRVGRAMVFQEILHDEQLGFEQKIEEENTQSMLEGENLLIEDLPGSPAIRRSINQAVRIVDEIVGIAGHAPDNIFIEVTREDDTKKKGKRTTTRYSNIQKALEALKEEGAEALRELKTYKHNELDKRLSLYFMQNGKSLYSGIPLDIRRLSEYQIDHIIPQSYIKDDSYENMALVLPGENQSKADNLLISQDIRIKMKATWTALHKAGLMGDKKYNNLMNSSISDAKMKGFINRQLVETSQSVKLTQMMLSQKYPGAKVRPIKASISSQLRDACDLVKCREANDYHHAHDAYLACQVGRFVLKRHSSMFDNPIGMTKVIRDFVKRQGQEFKRNGKLPAYASRSGFIVQSFMRSGFDAETGELLRDDWNAPFEIARIKRCLNYRDCYISRMPMEDSGAFWDATIYSPKAGKKGALPVKQGLPVEKYGSYSREQFAYFFVYKAYNPKKKAYRLEFEAVPVRVASAVETRENALEEYAKSVAKQAGLEFVEVARPKVYKYQLIELGEDRLYITGKREVRNASQLAFSLDEIDLLKRLAEGEETSSEERERLFDVLIEKYARYAPRLARQLSVDSMSATFETLNAEEQLGILLSLVEIANGKRNMIDLSSAGGSKNAGCMNPTFSSELSSPGSNFTFIDQSVTGMFERRQRLEL

SEQ ID NO: 1097 - protein, 1381 aa, Artificial Sequence
  Cas9
MVKKKYAIGIDIGTNSVGWSIVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDRYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYEPEHIVVEMARENQFTNQGRRNSQQRINRLENALKDFGSKILEEQKPYGVSKVNNIHLQSDRLFLYYLQNGKDMYTDEELDIDHLSEYDIDHIIPQAFIKDDSLDNKVLTKSAKNRGKSDDVPSMEIVHNRKNFWRQLLKSKLISQRKFDNLTKAERGGLTNEDKARFIQRQLVETRQITKHVARMLDTRFNTKLDEAGNRIRDPKVNIITLKSNLVSQFRKDYQLYKIREINNYHHAHDAYINAVVATALLKKYPQLAPEFVYGEYPTYNSYNSRKSATEKVLFYSNIMNFFKRIVVHSKTGEVRIRPVIEVNKETGEIVWDKKSDFRTVRKVLSYPQVNVVKKTEVQNHGLDRGKPKGFYNANLSPRPKEGSVENLVPAKQSFDTKRYGGYAGISNSYAVLVNGIIEKGKKKSKAEVTEFQGISILARKDFDKNPKQYLLNLGYKDIKSIIKLPKYSLFELENGSRRMLASILSTNNKRGEIHKGNEMYLPDKFVTLLYHAMRVNRTLEPGHKKYVETHRHVFDELLIYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 1098 - protein, 1381 aa, Artificial Sequence
  Cas9
MNYVKEYHIGLDIGTSSIGWAVTDSQFKLMRIKGKTAIGVRLFEEGKTAAERRTFRTTRRRLKRRKWRLHYLDEIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKFLEVKVADKEETKRNKQIATAISKLVLGYKADFATVAMANGNEWKIDLSSETSEDEIEKFREELSDAQNDILTEITSLFSQIMLNEIVPNGMSISESMMDRYWTHERQLAEVKEYLATQPASARKEFDQVYNKYIGQAPKEKGFDLEKGLKKILSKKENWKEIDELLKAGDFLPKQRTSANVVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYSELFKKKKTVKASDVASLVMAKTRGVNKPSVEGLSDPKKFNSNLATYLDLKSIVGDKVDDNCYQTDLENIIEWRSVFEDGEIFADKLTEVEWLTDEQRSALVKKRYKGWGRLSKKLLTGIVDENGQRIIDLMWNTDQNFMQIVNQPVFKEQIDQLNQNAITNDGMTLRERVESVLDDAYTSPQNKKAIWQVVRVVEDIVKAVGNAPKSISIEFARNEGNKGEITRSRRTQLQKLFEDQAHELVKDTSLTEELEKALDLSDRYYLYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKRGSDLKLRNFNFFHELMEGDKSQGKVVDQQTGELITTRDEVAKSFDRLLNMKYMLVSKEVHDRSDQLYGATIVTAKESGKLTSPIEIKKNRPVDLYGAYTNGTSAFMTIIKFTGNKPKYKVIGVPTTSAVGLKRVGKPGSESYNQELHRIIKSNPKVKKDFEIVVPHVSYSQLIVDGDCKFTLASDTYQHPATQLVLSKESMEIIADDFKFVKENPATADEQLVRVFDEIVNQMNHYFTIFDQRSNRQKVTKARDKFVSLPTESEYEGAKKTQVGKTEVITNLLMGLHANAAQGDLKVLGLSTFGFFQSSGGLNLSEDAMIVYQSPTGLFERRICLKDI

SEQ ID NO: 1099 - protein, 1381 aa, Artificial Sequence
  Cas9
MKQILKKVQGYNIGLDIGTNSVGWVVTDENANLLQFRKKNMWGARLFEKGDTAQGRRLSRSTRRRYDRRRQRIHYLQEMLATMVLPIDESFFIRLNEAFLWKEDKSVQRDYILFADKQFTDRDFYKQFKTIYHLRKFLLDTKEKADPRFIYLALHHMIKYRGNFLYQGQSFDVVENVQESFRVLLEEMYEQLGKEWEYGEHFDDIQRILENTTIGKKSKQEQIAAILTEQYGNKKLANEVTRACLGYSFDLTVVMENENLLDESGKKIKISFSDSKYEEQELELQNRLEEKFAVIEALKRIYNWLVLKDTLRGKKYISEAMVNKYEAHHEDLVKLKRLFRTYLSTEEYSCFFRKEKQKDKYISNYVNYRKGAERCSKEKLYKAIHELFDTVAKDDVVYQEIVEKMDQGEFLTKQNEVSNAYIPYQCNEVEMKRILKQQGEFYPELKENADKILQLLLFRIPYYVGPLVDEKQSKFAWMKRRTGMEQVKIYPWNFEQVVDIDQTAEAFITRMTNYCTYLPEEKVLPKQSLLYSEYELLQELNKIKINGKFSLETRNKIIEQLFKKQKKVTEKQLKKWLVREQYCTTKVTEKMVKLDENAYYITGFQKENEFASSLTSYIDFTKILGEITERNRKMIEEIIYWLTVFEEKSIVKRKIQKKYGNEINDKQLAQILKLNYSGWGRFSEKFLNGIKGFDRQGQKKTIMELLREDSRLLNIMQIINNEEMGFCKIIEANQKKLYGNENLLDVVQELHGSPAIKRGIWQSLKIVEEIISIMGGVPQNIFIEFAREDDDRVRTNSRVKQIERLYKKFKEEVNDFNEHAANELKEKRYQNRIDEEKVFLYFMQNGKSLYSGVTLDIDRLNEYEVDHIIPRTLVKDDSLENKALVLKGENQRKGEGLIPHEWQNRQKEVWKKLLSCGLMGKKKYANLCKESFGNEKEQKHFIARQIVETRQIIKQVANILAQYYQGVNVAAVKASLGSELRENYTIEKKDDNGFFMENKSYTMLKSRKINDFHHAQDAYLACAVGLYIKAAFPKYEKEIDYEGYRKYYQKKNQQKDGVRNEKRQFFSYVMSRFSEQIVDKETGEILWDGTQKLAYIKKIFGYRDCLITKKLEENTGEFYKQTINAKPEKGKENNTKLLPIKKGLSVEKYGGYQGGEAAYSCLVRYQQGRKTKLSLEKISVIIAKKIAEKEVSLDRYLKEKLGVEEIVILRKKVMKNQLIEDSDGNRFYLTAATEVVNAKQFILDGKHQHLLRTIAIMEKGEYYGYRLDELENSMDELYAYYRMKIQQQYPAYESIVKKIVESHVYESLHVEEKIKAVQEKGKFLIQLLRLTEANAECIDLKTISDGRLADRIGRKNHYTIKEGIKFIDQSITGLYERYMTV

SEQ ID NO: 1100 - protein, 1381 aa, Artificial Sequence
  Cas9
MDYVKEYHIGLDIGTSSIGWAVTDSQFKLMRIKGKTAIGVRLFEEGKTAAERRTFRTTRRRLKRRKWRLHYLDKIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMANGNEWKIDLSSETSEDEIEKFREELSDAQNDILTEITSLFSQIMLNAIVPNGMSISESMMDRYWTHERQLAEVKEYLATQPASARKEFDQVYNKYIGQVPKEKGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKAGDVASLVMAKTRGVNKPSVEGLSDPKKFNSNLATYLDLKSIMGDKVDDNRYQMDLENIIEWRSVFEDGEIFADKLTEVEWLTDEQRSALVKKRYKGWGRLSKKLLTGIVDENGQRIIDLMWNTDQNFMQIVNQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKAPDLSDRYYFYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKNRPVDLYGAYTNGTSAFMTIIKFTGNKPKYKVIGVPTTSAVGLKRVGKPGSESYNQELHRIIKSNPKVKKDFEIVVPHVSYSQLIVDGDCKFTLASDTYQHPATQLVLSKESMEIIADDFKFVKENPATADEQLVRVFDEIVNQMNHYFTIFDQRSNRQKVTKARDKFVSLPTESEYEGAKKTQVGKTEVITNLLMGLHANAAQGDLKVLGLSTFGFFQSSGGLNLSEDAMIVYQSPTGLFERRICLKDI

SEQ ID NO: 1101 - protein, 1381 aa, Artificial Sequence
  Cas9
MKKSYAIGIDIGTNSVGHCVMYTENYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKDFIRQNLSDSYKEFFNDTLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLKRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLMGLDKDNKSFNASLGTYHDLKKIVSKDLLDNPENEDILENVVLTLTLFEDREMIRKRLEKYKDVLTEEQRKKLERRHYTGWGRLSAKLINGIRNKTTRKTILDYLIDDGTSNRNFMQLIHDDTLSFVDEIRLAQGSGEAEDYRTEVQNLAGSPAIKKGILQSLKIVDELIGVMGYNPEHVVVEMARENQFTNQGRRSSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDDAGNRIRDPKVNIITLKSSLVSQFRKDYQLYKVREINNYHHAHDAYLNAVVATALLKKYPQLAPEFVYGDYPKYNSYKSRKSATERVLFYSNIMNFFKRVVKSSKTGTVKIRPIIEVNKETGEIVWDKKSDFRTVRKVLSYPQVNVVKKTEVQNHGLDRGKPKGFYNANLSPRPKEGSVENLVPAKQSFDTKRYGGYAGISNSYAVLVNGIIEKGKKKSKAEVTEFQGISILARKDFEKNPKQYLLNLGYKDIKSIIKLPKYSLFELENGSRRMLASILSTNNKRGEIHKGNEMYLPDKFVTLLYHAMRVNRTLEPGHKKYVETHRHVFDELLTYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 1102 - protein, 1381 aa, Artificial Sequence
  Cas9
MKKIIGLDLGTTSIGWAYVHEAESAQERSEIVRLGARVVPLTTDEQDEFKKGKSITTNAARLSKRSLRRNADRFQLRRDELAGVMKEAGWIDETTVLAEQGPRSTFETLRLRAKAASEEVTLAEFARILLQINRKRGYKSNRKTDGDEEGALIDGMDVSKQLNASGQTPGEWVLARMQEGNAVIPAFYCSDLSEELDRIWRKQQASHQAWMTEELHTVLRHADGRSAIRLMDKAGVVPDSVNVKERRRVMYEWRAAAVRDCLPAGRVAAALMQVSKEIGRADSYLGRIGDRSKELYFHRQTVGQYLWRLICDNPNQSLKNLVFYRQDYQHEFETLWSIQTKYHVELTEDLRKRVGRIIFFQRPLKSKKGLVNRCELVHYSVCENSGDDLTEKVDVGPKVCPKSSPLFQEFKVWQVLNNVEVIHPSTQEARRLEMEEKELLASELLFRDRMKKIDVLKLLFSNWRDLDLNYKELEGNRTMAAFYRVYEQVIAQTGHGDYDFAKMRAAKVKELAEGVFAGLGFEVGLLTFDAELDSPAYEQQPCYRLWHLLYSYEGDKSATGNKCLLKKLCRLTGMNAELVGLFMQIRFSGDYGSLSTKAMRRILPYLKAGNTYDVACEYAGFRHSARSLTREELAQKEYKDYLDLLPRNSLRNPVVEKILNQMIHVVNGLSSTYGKPDEIRVEMARELKKSAREREEMTSAISKTTKENAEITAILQRDFGLRYVSRNDILRYKLYCELRIKGNGCRTLYSNTYINPNELFSREFDIEHIIPQSRLFDDSFSNKTLESRTANLEKGDRTAWDYVNEKYGAERADEYRAQVEALYRDGTISKAKRDKLLMPGDKIPEDFIDRDIRNTQYIAKKALEIFEDFVPSVVATSGNVTARLREDWGLVDVMKELNWSKYESQGMVHIEYDRDGRPIRRIVDWTKRNDHRHHAMDALAVAFTKRSYIQYLNHLNARKEATSVAYAIQHKEMELDGSNRWRFKCPFGDRSAFRREAKAQLERILVSIKSKNKVLTPSVNRTKKRGGFNKKVEWTPRGALHNETVYGRIRRYDVKELRVGSSFTAEVIGKVADSRYRAALMHRLAEFGGDPKKAFTGKNSLEKNPLYTDEAHTACVPSSVKVVSFVEIGTIRKGVDPNLNVDKVVDTHIKNILLARLSAYGGDAKKAFSNLDADPIWLNKEKGIAIKRVTISDDSEVRPIHVKRDMRGRLVCDEHGRPVPSDYVQLRNNHHVAIFRDANGELKERVVTFFEAVERVRQLRSEGRAVEVIDKNYKCEEGWTFLFSMKINEYFVFPDAASGFDPREIDLTDPANYALISPHLFRVQKLSSKDYYFRHHLETTVNDVKQLRDITWKRISSLQDLAGTVKVRVNHIGQIVAVGEY

SEQ ID NO: 1103 - protein, 1381 aa, Artificial Sequence
  Cas9
MVKKKYAIGIDIGTNSVGWSIVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDRTFKVYRKVTKEKLMDFLSKEFDEFRIVDLLGLDKDNKSFNASLGTYHDLKKIVSEDFLDNSENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGKAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVYKKKNFWQQLLDSQLISQRKFDNLTKAERGGLTNEDKARFIQRQLVETRQITKHVARILDTRFNTKLDEAGNRIRDPKVNIIILKSNLVSQFRKDYQLYKVREINNYHHAHDAYLNAVVATALLKKYPQLAPEFVYGEYPTYNSYNSRKSATEKVLFYSNIMNFFKRIVVHSKTGEVRIRPVIEVNKETGEIVWDKKSNFRTVRKVLSYPQVNVVKKTEVQNHGLDRGKPKGFYNANLSPRPKEGSVENLVPAKQSFDTKRYGGYAGISNSYAVLVNGIIEKGKKKSKAEVTEFQGISILARKDFDKNPKQYLLNLGYKDIKSIIKLPKYSLFELENGSRRMLASILSTNNKRGEIHKGNEMYLPDKFVTLLYHAMRVNRTLEPGHKKYVEAHRHVFDELLTYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 1104 - protein, 1381 aa, Artificial Sequence
  Cas9
MVKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSDNKDVQHLFNEFVEMFDKTVEGSYLSENIPDVADILVEKVSKSRRLENVLQYFPNEKKNGLLGNFLSLALGLQPNFKTNFELAEDAKIQFSKETYEEDLEELLGKIGDDYADLFIATKSLYDGILLAGILSTTDSTTKAPLSSSMVNRYEEHQKDLALLKDFIRQNLSDSYKEVFNDALKDGYAGYIEGKTTQEDFYKFVKKTIEKIEGSDYFIDKIDREDFLRKQRTFDNGSIPHQIHLKEMQAIIIRQAKFYPFLEENQDKIEKILTFRIPYYVGPLARGNSEFAWLNRKSDEKIRPWNFDEIVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKEVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYEPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVYKKKSFWKQLLDSQLISQRKFDNLTKAERGGLTNEDKARFIQRQLVETRQITKHVARMLDTRFNTKLDEAGNRIRDPKVNIITLKSNLVSQFRKDYQLYKVREINNYHHAHDAYLNAVVATALLKKYPQLAPEFVYGEYPTYNSYNSRKSATEKVLFYSNIMNFFKRIVVHSKTGEVRIRPVIEVNKETGEIVWDKKSDFRTVRKVLSYPQVNVVKKTEVQNHGLDRGKHKGFYNANLSPRPKEGSVENLVPAKQSFDTKRYGGYAGISNSYAVLVNGIIEKGKKKSKAEVTEFQGISILARKDFDKNPKQYLLNLGYKDIKSIIKLPKYSLFELENGSRRMLASILSTNNKRGEIHKGNEMYLPDKFVTLLYHAMRVNRTLEPGHKKYVETHRHVFDELLIYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 1105 - protein, 1381 aa, Artificial Sequence
  Cas9
MVKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRHLENILHYFPNEKKNGLFGNFLALALGLQPNFKTNFELAEDAKIQFSKETYEEDLEELLGKIGDDYADLFIATKSLYDGILLAGILSTTNSTTKAPLSSSMVNRYEEHQKDLALLKNFIHQNLSDSYKEVFNDKLKDGYAGYIEGKTTQENFYRFIKKAIEKIDGSNYFIEKIEREDFLRKQRTFDNGSIPHQIHLQEMQAIIRRQAKFYPFLEENQDKIEKILTFRIPYYVGPLARGKSEFAWLNRKSDEKIRPWNFDEMVDKETSAKNFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKENKSFNASLGTYHDLKKIVSKDFLDNSENEDILENVVLTLTLFEDREMIRKRLEKYKDILTEEQRKKLERRHYTGWGRLSAKLINGIRDKVTRKTILDYLIDDGTSNCNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLDSNLNSKILKEYPTNNQALQNDRLFLYYLQNGKDMYTDEELDIDQLSQYDIDHIIPQAFIKDDSLDNKVLTKSAKNRGKSDDVPSLEIVYKKKSFWKQLLDSQLISQRKFDNLTKAERGGLTNEDKARFIQRQLVETRQITKHVARMLDTRFNTKLDEAGNRIRDPKVNIITLKSNLVSQFRKDYQLYKVREINNYHHAHDAYLNAVVATALLKKYPQLAPEFVYGEYPTYNSYNSRKSATEKVLFYSNIMNFFKRIVVHSKTGEVRIRPVIEVNKETGEIVWDKKSDFRTVRKVLSYPQVNVVKKTEVQNHGLDRGKPKGFYNANLSPRPKEGSVENLVPAKQSFDTKRYGGYAGISNSYAVLVNGIIEKGKKKSKAEVTEFQGISILARKDFDKNPKQYLLNLGYKDIKSIIKLPKYSLFELENGSRRMLASILSTNNKRGEIHKGNEMYLPDKFVTLLYHAMRVNRTLEPGHKKYVETHRHVFDELLIYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 1106 - protein, 1382 aa, Artificial Sequence
  Cas9
MKKIVNYNLGLDIGTSSIGYAAIDDQGRPVRHQNKTVMGVRLFKEGKTAESTRIFRGTRRRLSHRHWRLGYLDRIFDNEIAKVDENFLPRLKASKRARSDEKRSFRGSLLFPETGDDAYYQKYPTIYHLRYALITQKKQFDIRLIYLALHHMIKYRGNFLDTTPVSAFNIHDIDLTDQFASLNDCYQLLDMDFEFQFDLNNIEQVQKLLLDETLSKTKRQAAVSKVLVMSTGNKAFDDQQNGIASEFIKALLGGPFDLSKILNLSVADVKSWKLHMTDKDVDDTLNSLVEELDENHKQIVNLLQMIYSQVMMLGLLNGQQSISASMIERYDDHAKHWAALKKLLPALGEQEQSTIIHAYTAYTGHSRTKQLSRAEFYTKVNSILKKHENIAEATGLIELIDRNEFMPKQRDAVNGVIPHQLHQRELQLIIQNQQKYYPFLAAKAYPDADETMIEQLLSFRVPYYAGPLVDRDFINESSDQEQAMQNTKFSWLKRREAGEITPWNFEQKVDVQETANRFIKRLTTKDTYLMTEDVLPKESLIYQRFEVLNELNAIRINDRRLTAENKQLAFQQLFMAGNTKNVSIKKFRNFVFDSLKFPEKVKITGFAGQHNFLAKLSTYHDFKKIFGERVDHTDLQPDFERIVEWCTIFEDRHIYREKLKEIQWLSQSEIDQLVLIRNHGWGRLSKRLLTGIRDSDGRTVMDQLWFGTDNFMRIISQSDFAAAIANENRTQLNQHGLEDVLDSAFMSPQNKKAIRQVLKVVDDIEQTLGCPPKKVMIEFTRSPDKKKQRTVTRLEKVQQAYKAVADQLAGQSIVSELDQYANTHSKLSDTYYLYFMQLGRDLYSGKPIDIDSPMLDDDHILPRAFMKDNSLDNRALTEKPINNTKAAKFPSKVFGQQKEVTDFWKLLRRCGLMSNIKEKHLYLDPDNVDKWTRRGFIHRQLVETSQVIKIVANILNDRYQQSQTEVLEVPARLGTELRECFGWYKVREVNDYHHVFDAYLAAFIGNYLYRRYPKLQPYFVYGNFAELNKAQLKNIKSFNFLYNITDNKRVVKDIETGQTLWDDQIRQQIQHIYEYKYMLTSHEAFTQHKELYGQTIYPRREFKPGTLKAIKQDQPQELYGGYKNLTAAYMCIVKIQARKRRAAEYRVVRVATESLSALQQAKRLGVQAYERCLRQELVRNNEILRTNADPNSAPREFEVLLDRVLCHQMIISDGQKYLLGSHAYKINCMQLVLSNNSMKILSTSIVKLKQMTNEPLVQVYREILDVVNKYFTLYDVNSFRENLNQFFDKFRTLPITNEYESSKSGKKLIHRGQLETLTLILRGLHANSDKVQYGDQSTLLGGFQTKDGIKLSKDSVIQYTSPAGLNVRTVKLRDLEQKEAQK

SEQ ID NO: 1107 - protein, 1382 aa, Artificial Sequence
  Cas9
MVDEKIFWGLDIGTDSVGWAVTNSEYKLKKYKNNLMWGVHLFDEAKQSAERRSFRTARRRLDRRKQRIILLQEFFVRAVCEKDENFFRRLKESALLPEDAEHRTNNIFFDDPDYTDKDYFEEYPTIHHLICELMESKEPHDVRLVYLACVYLLAHRGHFLLPVSEDDISKVTEFEPLYESFYKALEEKLDDEPPFDRSADDFAEILKSHKTVSAKNKDFDKLLFGGKVKTYDNENISYSALIKLLSGGTEKLSKFFANEEYTDLEKDSVCVRNADFGDTLEMLEGQIDELDFALLKSVKSLYDWSLLVDILEGKSLISEAKKDKYDEHGYDLDALKYLFREYLTKDDYNEMFKEVSGKQNYASYVYNASSDKTRDSKYKKCSQKDFCKFTKKFLSKIKPNEKDKPCLDKLLEKCEQNSLCPKQVTTDNRVIPYQLYYVELKKILENACGYLPFLNERDEYGTVADKILSIMKFRVPYYVGPLVDSKKSPNAWLVRKLDGKITPWNFTDMVNEDESENAFIRRMTCKCTYVAGQDVLPKYSLLYSKFSVLNEINNIKLNGEPISVQTKQEIYTELFERNKSRVSKKKIRDCLISHGYAADSDEVTGIDDIAKSALRSYHDFKKMLSNGILTEQQVEEIIEHITVTTDNIRLKKWLKTQFPMLADEDVKYITKLKYKDYGRLSRCFLEDVLPVDTKTGEAESDKNIITMLWETNENIMQLLSSKYRYSENIEHMNRQYYALPENHKSMSERLKDMYVPTAVRRAVTRTFDIVKELKKIQGRDPDKIFIEMARGTGETPKGKRTNSRKDQILEHWHGLDNKDINDLKKSGIWEHLDTIDDAKLRSDKYFLYFMQLGRCMYTEKPIPFEEVENEHKWNIDHIWPQAKIKDDSLDNKVLVSSNENGKKSDSYPISDDIRHSMAGLWHSLYKKGLISEKKYQRLTRSTPFTDDELSGFIARQLVETRQSTKAVATLLKEQFPNTEIVYVKAGLVSDFRQEMGMLKCREVNDLHHAKDAYLNIVLGNVYNTRFTKDPLNFVKNNEKYSIKIFQKNSDGKKTGVITRKVERGGEVAWDPETSFAIVRKMMSKNSIRYVRYAYMRKSGQNGGFFDQNPLRKGKGMVSIKHNLSIEKYGGYDNATISFFSLVSIKDFGVILLAVELLSANKFLKNISEAKEYAADKLSKELNVKIVPNDVAFPLNNRYNVVKINAVLELDGYRVMIAAKQNSSIKFVSNESLILSSQHMAYVKKITKFIEKRKQDKVCMINAFSGISIEDNIELYDVLVSKCNIKPFNIMYENLGIKLSDNRDNFIKKSVENQVLILSEMVRLFKTGRKAGVNLEEVGGRKNSGVKTLNTCLYKVKDYSNIFLVDQSPTGLIEHKSPNLLDL

SEQ ID NO: 1108 - protein, 1384 aa, Artificial Sequence
  Cas9
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 1109 - protein, 1384 aa, Artificial Sequence
  Cas9
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 1110 - protein, 1385 aa, Artificial Sequence
  Cas9
MTKPYSIGLDIGTNSVGWAVITDDYKVPSKKMKVLGNTSKKYIKKNLLGALLFDSGITAEGRRLKRTARRRYTRRRNRILYLQEIFSTEMATLDDAFFQRLDDSFLVPDDKRDSKYPIFGNLVEEKVYHDEFPTIYHLRKHLADSSKKADLRLVYLALAHMIKYRGHFLIEGDFNSKNNDLQKNFQDFLDTYNAIFESDLSLENSKQLEEIVKDKISKSAKKDRILKLFPGEKNSGIFSEFLKLIVGNQADFRKYFNLDEKTSLQFSKESYDEDLETLLGHIGDDYSDVFLKAKKLYDAILLSGILTVTDNGTEAPLSSAMIMRYKEHEEDLALLKAYIRNISLETYNEVFKDNTKNGYAGYIDGKTSQEDFYVYLKRLLAGLEGADYFLEKIDREDFLRKQRTFDNGSIPYQIYLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYENFTVYNELTKVRFIAEGMRDYQFLDSKQKKDIVRLYFKGKRKVTDKDIIEYLHAIDGYDGIELKGIEKQFNSSLSTYHDLLNIINDKEFLDDSSNETIIEEIIHTLTMFEDREMIKQRLSKFDNIFDKSVLKKLSRRHYTGWGKLSAKLINGIRDEKSGNTILDYLIDDGVSNRNFMQLIHDDALSFKKKIKKAQIIGDKDNIKQVVKSLPGSPAIKKGILQSIKIVDELVKVMGREPESIVVEMARENQYTNQGKSNSQQRLKRLEESLKGLGSKILKENVPTRLSKIDNNALQNDRLYLYYLQNGKDMYTGEELDIDRLSNYDIDHIIPQAFLKDDSIDNKVLVSSASNRGKSDDVPSLEVVKKRKTLWYQLLKSKLISQRKFDNLTKAERGGLSQEEKAGFIQRQLVETRQITKHVARLLDERFNNKKDENNRTLRTVKIITLKSSLVSQFRKDFELYKVREINDFHHAHDAYLNAVVASALLKKYPKLEPEFVYGDYPKYNSFRERKSATEKVYFYSNIMNIFKKSIPLADGTVIDRPLIEVNEETGESVWNKVADLNTVRKVLSYSQVNIVKKVEEQNHGLDRGKPKGLFNANLSSKPKPNSKENLVGAKEYLDPKKYGGYAGISNSFAILVKGTIEKGAKKKITNVLEFQGISILDRIYYRKDKLNFLLEKGYKDIELIIELPKYSLFELSDGSRRMLASILSTNNKRGEIHKGNQIFISQKFVKLLYHAKRISSTFNENHRKYVENHKKEFEELFYYILEFNENYVGAKKNGELLKSAFQSWQNHSIDELCSSFIGPTGSERKGLFELTSRGGAADFEFLGVKIPRYRDYTPSSLLKDATLIHQSVTGLYETRIDLGKLGED

SEQ ID NO: 1111 - protein, 1385 aa, Artificial Sequence
  Cas9
MQTYFGMKKILGLDLGTNSIGWALVNEANDDNEKSSIIKLGVRVNPLTVDEQSNFEKGKSITTNAERTIKRSIRRSLQRYKLRRENLIEILKEHNFITDDTILSEDGNASTFETYRLRAKAASEKISLEELGRVLLMINKKRGYKSSRKAKNQEEGQLIDGMEVAKELYEKNITPGQFVFQLLKQGGKFIPDFYRSDLQAEFDKIWEFQKLFHAEILVDDFKKQLERKGKLNSSKIFLGRFGIYTAENKGNDKRLQAYQWRVDALTKELTKEELAYVISDLNGIISSSSGYLGSISDRSKELYFNNQTVGQFLMAQLDHSPHTSLKNQVFYRQDYLDEFNTLWENQAHYHKVLTSDLKSEIRDVIIFYQRRLKTQKGLISFCEFESRKIEVEIDGKKKIKNVGSRVCPKSSPIFQEFKIWQILNNIELLEKSSKAKRFLDQEEKELLFKELSIKSKISKSDALKLLFKNSRELDLNYKEIEGNRTQSALFDAYSKIIELSGHGEYDFSKMEASNIIELVQEVFTGLNYNTEILYFDSSLEGKDFENQPMYRLWHLLYSFEGDDSKTGNEKLINKLSELYGFEKKYSIVLANVSFQEDYGSLSTKAIRKIHPYLKEGIQYDVACEFAGYRHSKSSLTKEEIENKILKDQLEILPKNSLRNPVVEKILNQMINVVNALNESYGKPDEIRIELARELKKSAKEREELTASIGETTIKHEKYRAILENEFGISHVSRNDIIRYKLYLELENRGYKTLYSNTYVSQEKLFSKEFDIDHIIPQSCLFDDSFSNKTLESKSVNIEKGNDTAFDYVFAKYGEAGLSDYIIHIEELFKDGKISKTKLNKLKMKGNEIPSDFIARDIRDTQYIARIAKNILEETVRNVVSTSGSITDRLREDWQLIDVMQELNWEKYSALGLTEIYENREGHTIRRIKDWTKRNDHRHHAMDALTIAFTKRSHIQYLNNLNARSDKSGSIYGIETKELYRDDHGKLKFKPPIPLNEFRAEAKKHLENTLISIKAKNKVATININTTSTKEGKNKKRQLTPRGQLHLETIYGSIQQYVTKQEKVGASFNEEQISKVAKQKYRQALLNRLREFDNDPKKAFTGNNSFEKNPIYLDVLQTQKVPDKVETVSKEIIYTIRKDITPELKIEKVIDKKIKTILQSRLNEYSGDSKRAFSNLKENPIWLNQEKGIEIKRVTISGISNAVAIHDKKDKNGNLILDNEGSTQAVDFVNTGNNHHVAIYKDERGNLHESVVSFFEACTRVNLGGPVIFKNYNKSDGWEFLFSMKQNEYFVFPNEKTGFNPNEIDLLDPDNYRLISPNLFRVQKISSKNYVFNHHLETSAITGETLKNKKQLSSVTYHFIQSLPPIKDIVKVRINNIGQIVWVGEY

SEQ ID NO: 1112 - protein, 1385 aa, Artificial Sequence
  Cas9
MDELQNFEKGKSITTNADRTAGRSMRRNLQRYKLRRENLIEVLKEYNFITDEMILSENGNRTTFETYRLRAKAAVEEISLEQFARVLLMINKKRGYKSSRKAKGAENGTLIDGMEVAKKMYDEGITPGELCLQLLTAGKRYFPDFYRSDLQAEFDRIWNFQKQFYPDSLIDKVKDEVRGKNKSQTWAILAKYFVWKEVENSWNEEEAQTRRVEKEYRLVGIKRGVKREELKLENFQWRVKALSERMNPEELAIVLQEINEQISNSSGYLGAISDRSKELYFNRQTVGQYQMAVLDNNPNIGLRNMVFYRQGYLGEFNTIWEKQAEFHKELTEDLKKEIRDIVIFYQRRLKSQKGLINICEFERRQIEVEIDGKKKIKTIGSRVIPRSSPLFQEFKIWQTLNDIEVSVLGVKNKRKKQDDNSTTLLDSAENIDSLKLNVSRPLDADEKSLLAKELFIRDKLTKSDVLKLLFNNPQNLNLNFKNIDGNRTGSALYQAFSKILEISGHESINFKKSADEIVEQVKTIFSALGWNTEVLCFDSEKELDKQPYFKLWHLLYSFEGDSTPTGDGNLIQKIADLCGFEKDYASILANITFQEDYGSLSTKAIRKILPHLKDGNQYDVACEYAGYKHSKSSLKKEEIKNKVLKDKLELLPKNSLRNPVVEKILNQMVNVINAIITTYGKPDEIRIELARELKKKAKKREELTKTIVDTTKTHEGIRAILQNDFGMSHVSRNAIIRYKLYEELKDNGYKTLYSNTYIPKEKLFSKDFDIEHIIPQARLFDDSFSNKTLEVKSINIEKGSKTAYDFVEEKYGEQGLQEYLNRCEVLFRDKKTKLRKLKMQESEIPEGFIDRDLRNTQYIAKKALSMLNEICRRVVATTGAITDELREDWQLVDVMKELNWEKYKVLGLVEYFEDNDGRLIGRIKDWTKRNDHRHHAMDALTVAFTKDVFIQYFNNKNASLKPDTNEAAIRNKYFQNGKAIPPMSLDEFRAEAKKHLNDTLISIKTKNKVVTINLNRTKKKNGINKKQQQTPRGQLHLETVYGSHKQYVVKEEKVNASFDAAKIATVNKPAYRDALLRRLQENGNDSKKAFTGKNSLDKQPVWLDAKQNECVPEKVKTVMLETVYTVRKPIDEKLNVDKVVDARIRKLLQDRIKEYGNAKSAFANLDENPIWLNKEKGITIKRVSVSGISKAQSLHEKKDKDGNFILDKDSRRIPVDFVNTGNNHHVAIYRKPVLDKKGQAVFDENGELKFELEEVVVSFFDAVTRVNLSQPIIDKDYKRSEGWKFLFSMKQNEYFVFPNEKTGFDPKEIDLLNPENYALISPNLFRVQKIASKDYVFRHHLETVVADRKELQEITWKRISSLSILNRIIKVRVNHIGQIVMIGEY

SEQ ID NO: 1113 - protein, 1385 aa, Artificial Sequence
  Cas9
MTKPYSIGLDIGTNSVGWAVITDDYKVPSKKMKVLGNTSKKYIKKNLLGALLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKSAKKDRILKLFPGEKNSGIFSEFLKLIVGNQADFKKYFNLDEKAPLHFSKESYDEDLETLLGYIGDDYSDVFLKAKKLYDAILLSGILTVTDNGTEAPLSSAMIMRYKEHEEDLALLKAYIRNISLETYNEVFKDDTKNGYAGYIDGKTSQEDFYVHLKKLLVGLEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKNKRRVTDKDIIEYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGVSNRNFMQLIHDDALSFKKKIKKAQIIGDKDNIKQVVQALPGRPAIKKGILQSIKIVDELVKVMGRRPESIVVEMARENQYTNQGKSNSQQRLKRLEESLKELGSKILKENIPAKLSKIDNNALQNDRLYLYYLQNGKDMYTGEELDIDRLSNYDIDHIIPQAFLKDNSIDNKVLVSSASNRGKSDDVPSLEVVKKRKTLWYQLLKSKLISQRKFDNLTKAERGGLSPEAKAGFIQRQLVETRQITKHVARLLDERFNNKKDEDNKTLRTVKIITLKSSLVSQFRKDFELYKVREINDFHHAHDAYLNAVVASALLKKYPKLEPEFVYGDYPKYNSFRERKSATEKVYFYSNIMNIFKKSISLADGTVIERPLIEVNEETGESVWNKVADLNTVRKVLSYSQVNIVKKVEEQNHGLDRGKPKGLFNANLSSKPKPNSKENLVGAKEYLDPKKYGGYAGISNSFAVLVKGTIEKGAKKKITNILEFQGISILDRITYRKDKFNFLLEKGYKDIDLIIELPKYSLFELSDGSRRMLASILSTNNKRGEIHKGNQIFISQKYVKLLYHAKRISNTFNDNHRKYVENHKKEFEELFYYILEFNENYVGAKKNGELLKSAFQSWQNHSIDELCSSFIGPTGSERKGLFELTSRGGAADFDFLGVKIPRYRDYTPSSLLKDATLIHQSVTGLYETRIDLGKLGED

SEQ ID NO: 1114 - protein, 1385 aa, Artificial Sequence
  Cas9
MKNKTWYLGLGVGPTSIGWAATDSNYKLLRKNKKRLWGVRLFEEAKTAVDRRTFRAERRRLARRKWRISLLEELFAKEVSKNDPNFFLRLKESKYHFEDKSLMNEYILFNDKDYTDKDYYKEYPTIYHLRLSLTTEENPDIRKVYLAVHSMLKNRGHFLLQGQSFNDSNIDSVIKELLELETVKINFEVTDEVIHSLKKIALEKKNLSDKNNDVKKLYPKEKQLQEIFKLVFGGKTSLDKLYDIEEYKELDNSVKSISFKEKVYEEVRPDYEQILSNYIELLDLAKLVYDSIVLADIKKEGKTISESKVELYNKHKDDLANLKKLVKIDSKLSEDKKKEVYFTIFKEDKEKGTNYVNYTHRSQEGKSCSYEDFKKFLKKELEKLEDSPTKTTILEELDLETFLPLQRTKDNSVVPYQIHKEELVKILDNAAKYHSFLAEKDDSGYSTREKVVQLFEFRIPYYIGPLNAHHNTENGGYSWAIRKKGMESVPVTPWNFKDVIDESASAEAFVNNLKNKCAYLSGEDVLPKNSLLYSEYALLNELNALRYEGNRISVEARDVIVTKLFKEQGKKVTKKTIKELLKTEGFIDGKGEIVGIDNIVKNDLKSYRDFKKILADKFDKERVENIILWITLYGESRKLIKEKITKVYGDFYTVDEIEKMSRLTYKDWGILSRKLLTELVSEKLYNEETGECLNIIGAMRQGTILFMELLADKFDYMSQIKNHNKENKDDITEITPDILENLHASPAVKRSIWQTVRIVEELKTIIGCVPTKIFIETTKRNNAPYKVPTLNRNDLVTKYKTIREHEIFELEKELKNTLDFTLNKNRLINEEPSKLKATKLYLYYTQLGRCMYTGKKIDLGELFDNNNKYDIDHIYPQSKVKDGSFNNIVLVTKASNDMKADVFPLKSKFQTKENKIFWRFLKEKKLITEEKYNRLVRTEEFSNGELTGFITRQLVETSQAIKVISNVLRELNPETTICYSKAENVSSFRQSFGKIKEANRKAENNEKLIRVQEINDYYNAKDAYLSIVVGNVYDVKFTRNVHNFIKNNKDARRYSLNGLFYTDVKNANTIAWEMDKTVHVVEKTMNNNNILITRRTSEQKGALYDATLYKAKVAEKAKEGTYYPLKTTDSKIKDVGKYGGFTKIKIAYYSIFEYTLDGKKGKQKITRIVPIPIYISQNIKDDKALLEYAQTRLPGKDLKIKYRKLCIGSLVKINNFNYYIGGKTNNNFTFDSAVQVILDKDSESYIKELAKYLNWKKENKDGKLWESITEDKNIQLYDSLVKKMNTGIFIRKTPNKYTELLTLEVKNKFINIDIDEQVKLLLEILNLLTNKKFTSKLNEIGITASRGVCSFNLSNQSQFSIIEQSVTGVYEKEKLIIEKKKEGIL

SEQ ID NO: 1115 - protein, 1386 aa, Artificial Sequence
  Cas9
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKNLDNPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 1116 - protein, 1386 aa, Artificial Sequence
  Cas9
MTKITEDYIVGLDIGTNSCGWVAMDSKNTILRMHGKTAIGSHLFDAGNSAADRRAFRTTRRRIKRRKWRLKLLEEIFDSHLAKVDPYFFARLKESGLSPLDTRKNVSSIIYPTSLEDKKFYVDNPTIYHLRYKLMTEDRKFDLREVYLAIHHIVKYRGNFLYNTPVKAFEASKIDVKGSLKKLNELYEGLDSEFNVELDSNNALEIENIIRDKKIFKINKVKEINQLLSLKTEDKERTKLMKDVSKQIVNAILGYKTKFETILLKDVSKDEADDWEFKLTDVDADNKFENLIGDLNENEQEILLVIRKLANAITLSNIVEEGKTLSESMKDKYKKHSDDLKLLKQVISDHPDRDKAKKLALAYDLYVNNRHGKILQAKDILEKKKTLSKEDFYKEIKKNLDDSKESQEILDAISLDSFMPKQRTNENGVIPYQLHQLELDKIIENQGKYYPFLKEVNPVSSHLKQAPYKLDELIRFRVPYYVGPLISPNESTKNKQTKKNQNFAWMIRKEQGQITPWNFDQKVDRMASANKFIKRMTTIDTYLLGEDVLPANSLLYQKFTVLNELNNVKINGKRISVPLKQELYNNLFKKNSTVTTNKLKSYLKENYKLIKVEIKGLSDEKKFNSGLTTYNKLKNLKIFDQQIDDPNYNKDFERIIEWSTIFEDKAIYKEKLKTIDWLSDRQIDKLSKIRMQGWGQLSKKLLSQLTDNNGQTIIEQLWDSQNNFMQIVNQADFKDAIAVANQNLLVDTSVEDILNEAYTSPANKKAIRQVVKVVDDIVKATSGKVPKQIAIEFTRDADDNAKISQSRANKLRKVYKEMSNELASETIRNELERVAKDQKLLKDKHYLYFMQLGRDAYTGELIDIDNLEQYDIDHVLPQSFIKDDSLENRVLVKKAVNNGKSDNVPVKLYGNRMATDLGMTIRHMWEKWKEQGLITKTKYNNLIIDPDKINKYESSGFIHRQLVETSQIIKLVSTILQSKYPDTEIIVVKARYNHYLRKRLNLYKSREVNDYHHAIDAYLSAICGNLLYQVYPYLRPFFVYGQYKKFSSEPEKEKIIYDKTRRYNFISQIFENKDNDIISRETKKKVFDKKDIIEKLKRAYNYKYMLVSRETETHDQEMFKMTVYPRLSRDTKKSRNLIPKKKDMPTEIYGGYTNNSDAYMIIARINKKKGPEYRVFGVPMRELVNLRKAEKNGHYKAYLKQVLEPEIMYSKNGKKNKTISSFEIVKAKVPYKQVILDGDKKFMLASSTYVQNAKQLTLSQYSMQAITDNCENDTEEEKALVEAYDEILTNIDKYLPLFDINKFREKLHAGREKFVDLPLAEKKETILQVLNGLHDNAVMPKIKSLGLSTPLGFMQFHTGVSLSENAKLIYQSPTGLFEKRLKISDL

SEQ ID NO: 1117 - protein, 1387 aa, Artificial Sequence
  Cas9
MSDSKKFEGENVKSGDKKTNKNHGKVLKSSPKEIRKNTEYFIGLDIGTSSVGWAVTNTDYEILKFNGKRMWGSRLFNEASTAEERRGHRVNRRRIQRRRDRLNLLEEIFSEEMAKVDPEFFMRLKESKFHLEDKDERILGESNIIFKGSEDGDKKYYEKYPTIYHLRHKLMQSCEDVDIRELYMALHHIIKYRGHFLFKGDFEETGTSIENIIIELLELINNNLGVKKFEYNESLINELKNIVSNTSNTITNKKKLLGEFFNKKEYKAHKSLFILSIGASVKPVDLFLEEEYKDIDDIKNISFKNLEYDQVRDTYESIFLDKIEFIDVAKRLYDATILLSIKPEGKTLSEAKVDIYNKHHNDLELLKKVLKTDKEKYDSILKLDIKKGNNYVNYVKKSKNGISCSKEEFHNALKKVLVKIEKTDDIKYILNEIELERFLPLQRVKDNSVIPYQIHRYELKKILENASKKFTFLNEESDGHTNIEKIIKIMEYRIPYYVGPLNDHHSVYNNGFAWVSRKRSGRITPWNFDEMVDKEESAERFIENLTNKCSYLIGEDVLPKESLLYSEFSLLNELNNIKYDGISLPIDIKKSIVEKIFRVEKKRVTKKYIKEFLKQEGYSDGKGEVSGIDIDIKSDLKSYRDMVKIFGTEIDYRMAENIIKWVTLFGDSKDLLKTKINKEYGEKVSKDQLKKVCKLKYRDWGRLSKKFLTGIRSSVLVNDATGEGYTIIEAMRNTDNNLMQLLRNEYDYLKKIDQINMLSRKDIDEISHDILDDLYCSPAVKRSLWQTIKIVEEIKKIMGHEPKKVFVEVTRTNKADKKTTITRKNRLLELYSAINAESRDWVNELNSTEVSKFNSKKLYLYYTQMGKCMYTGKNIDIESLFTDMYDIDHIFPRSKTKDNSFENLVLVTRKANADKRDVYPIDPKIQTERKSLWDMLHDKKLIGDKKYDRLTRTTGFTDDEMSGFIARQLVETSQASKAAAEMLKLINNDSEIVYVKAENVSDFRHENEFIKVREINDHHHAKDAYLNIVVGNVYNEKFTKNPANYIKKGGGNNYSLNCIFNRNLDRNGKRIWDEKKSIDTVNRMMKSNDVRVTFKNRVDKGPILNKVTIHKASEFMDDGKKNKKGFPIKSSEKNGNNRLCNLYKYGGYKDLNYSHYTIVRYNVYEKKGLDIKYYMIPIPYYLCLCNINQHDYVYDYISNRSKKDVNNIEIIVNELKMGSLINIDGYNYYLGGSKPKTFYVDPAYQIILDKEIERCIKEIVKAKNNEYRFINTDKINKNLNMKIYKYIVNKKIIGVFRNRKWDKGEYLNSSETIEKFSGLSVESQCNVILRLINDMRGSNKGGANSKFDELEMTISRAEIPQTLSNVSSFKIINQSITGLFENEVTIV

SEQ ID NO: 1118 - protein, 1388 aa, Artificial Sequence
  Cas9
MTKPYSIGLDIGTNSVGWAVITDDYKVPSKKMKVLGNTSKKYIKKNLLGALLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFKKYFNLDEKASLHFSKESYDEDLETLLGYIGDDYSDVFLKAKKLYDAILLSGILTVTDNGTEAPLSSAMIMRYKEHEEDLGLLKAYIRNISLETYNEVFKDNSKNGYAGYIDGKTNQEDFYVYLKNLLSNFEGADYFLEKIDREDFLRKQRTFDNGSIPYQIHLQEMRAIIDKQAKFYPFLANNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMSKYQFLDSKQKKDIVRLYFKDKRKVTDKDIIEYLHAIDGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTLWYQLLKSKLISQRKFDNLTKAERGGLSREDKASFIQRQLVETRQITKHVARLLDEKFNNKKDENNRAVRTVKIITLKSTLVSQFRKDFELYKVREINDLHHAHDAYLNAVVASALLKKYPKLEPEFVYGDYPKYNSFRERKSATEKVYFYSNIMNIFKKSISLADGTVIEKPLIEVNEETGESVWNKESDLATVRRVLSYPQVNVVKKVEKQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 1119 - protein, 1388 aa, Artificial Sequence
  Cas9
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 1120 - protein, 1388 aa, Artificial Sequence
  Cas9
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFIKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIQRYRDYTPSSLLKDATLIHQSVTGLYETRIDLAKLGEG

SEQ ID NO: 1121 - protein, 1388 aa, Artificial Sequence
  Cas9
MKRILGLDLGTNSIGWALVNEAENEKEISKIIKLGVRVNPLTIDEKTNFEKGRPLSTNADRTLKRGARRNLQRYKLRRENLIEILIDNHIITKETPLTEIGKGTTYQTLSLRAKAVRERIDLEDFAKVLLAINKKRGYKSSRKASNDEEGQAIDGMAIAKELYERGITPGQYVLELLENDRKYIPDFYRSDLKQEFNKIWNNQKTFYPEILTDELFKELDGKNKSQTWAICQKPFNIKGIKRITKGREKTIENYHWRVKGLSGKLNLEKLAIILQEINNDINQSSGYLGGISDKSKKLYLNKETVGEFLYKQIAKNPHTSLKNQVFYRHDYLDEFEQIWKTQSNFNANLTDELKQEIRDVIIFYQRKIKSQKSLISFCQFESWEQEYFDKETGKTKTRTVGRRVIPKSSPLFQEFKIWQNLNHLVFTNSETDEKIEIKEVEQEIRKELFEELNLRGDLNPNDLLKILRSQFKIGKLSNWKCNFEKIEGNRTNAALFNIYQKISDFEGYGIDWNKSNAKKIRKELKATFPEIGIDASILEFDAYKKQLTNQSSYELWHLLYSAEEDFKISEQDKLIYGNSSVSLKKKLHLKFGFNPEYAKMLANLSLMSDYGNLSAKAIKKILPYLEDGHLYSEACRLAGYNHSKSLTAEELEKFEPKAKLDLLKKNSLRNPVVEKILNQMVNVVNQVIDTYGKPDGVRIELARELKKSAKERAEMTKGIADGTRRNEEIKKIITQKFGIPNPTKSDLVRYRLWQELESRGYKDIFTDKYISPDKIFSSEIDIEHIIPKALLFDDSFSNKTLSFRNVNLKKANRTALDFITQDYQSNVEAYKERVETWNKDNHISKGKRNKLLMSLKDIPDGFIERDLRNSQYIARKAKRMLYEVFPNEVLATSGSITDKLRSDWDLINVMKELNLPKYKALGLTEYEERLDKGTEELFKHEVIKDWTKRNDHRHHAMDALAVAFTTHNHIQYINNLNARKDITQDNHPIIKNIENLITEVNSKGKRVFKAPMSSFRESAKEQIEAILVSFKNKNKVVTKNINQTKKEGGFNYQNAKTPRGQLHKETIYGKSKQPLEKPVKINNRFCKKQVGLIINFKEQEAVLHHLKKYDNNEKIAFSNKTLKSDPIQVNGSPLREVKIFEEIFTIRKDINPDNFKTQKHLDKIIDKGIKEVMKKRLEEYNGDFKTAFSDLDKNPIWLNQSKGITIKRATISGVTNAEPLHQAKDHLGNIILDDNGKEIPIDYVSTGNNHHVAIYQDESGNLQEEVVSFYEAVIRKNQDQPIIKKRHPKGWKFLFTMKQNEMFVFSSENFNPSEIDLLDEKNAAIISPNLFRVQKIATKNYMFRHHLETEVTNNLDFTYRHFQATEWLRNLCKVRIDHIGRIVQIGEY

SEQ ID NO: 1122 - protein, 1389 aa, Artificial Sequence
  Cas9
MIIRTYELKTITTIAILKMFQLLTGGLSMTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 1123 - protein, 1389 aa, Artificial Sequence
  Cas9
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 1124 - protein, 1389 aa, Artificial Sequence
  Cas9
MKNYNISLVPSPSGVGYAVTDDNLNIIKPVHHVSGIGSRLFNEGSSKQDRRNSRSARRSRHRQQGRIKALNSIMKDEIIKVDPTFFDRLYQSELSPLDKNKKYRNIIFDKPSVESYYYKKFPTIYHLEKYLINTDGKADIRLIYWALHSLLTHRGHFYNTTPVSQFKPGALNIKDKFIELNQLNQVKTFEFSVANTPEIEHILKDRYISKQNKINQLAELLFEQEPEKDIQKANTKVAKTIAKAILGNKFQLDEIIGLDVNKSEKKEWSLQLSDLNLDSKIDELSDSLTDQQLRILEILQEMYAATTLLDILQGSDSLLDAKIKSYNEYKQNRLLFFDLLKTLPDKKAHLLRQGYTLYLNNHHRDLASARKDLGIVAATNFSKTDLYALIKKTLKDEPETPESKKVLGLIDKGEFLNKQRTDLNTYIPYQLNALILNKILKNQGKHYPFLIKENPAEPDRKEAPYEISQLMQFTIPYYCGPLATPEEQKNLPESSRFGWLVRKEEGRITPWNFYNKINVIETANAFIKRSIGKDTYLLSEPVLPDNSLLYQKYKVLNELSSISLVDANTKKEKKLTAKIKQLLYKEGFKKHVTVSKTMALKILNDNNVPTSDILGLSTGKKFDNSLSTYNSWKKAFPEQIDNPHYRQDLEYMIEWSTVFTDRKILVEKLKEIEWLRPEQIKFVLEHRLTGWGKLSKRLLVELKDNKGKSNIDNLFNTKKNFMQIVSQQVYNTQIEAIALKTTKNQSLDNILEAAYTSPANRKAIRQTMKVVNEIVTLAGKGTHPDKIFLTFQRSKEQEGKLTTDRASSLLKIYRGIKDPLCTKELVDELSKNVRANLIKTKEYLYYQQLGRDALTGEIIDKTDLRNYAVLHIIPRSVVVDDSINNLVLTKVKNAKESIVVQYGSKNISDISMSVKDFWNRLQKLGLFSKGKLRNLTTDLTELNQYEKQGFIARQLVETNQIVKLLATILQGQFPHTKIIEVRQEQIANIRYQLDIYRLRDLNVYYRGMDAYLAAVVGTYLYTVYPKARRFFVYGKYLKQDKNNREEGQFKTSGHSFNFLWKLFYGGEDEIYVQGTNNIAFNKKDLLQKIKEVNNYKFQNVSLATGTRRSDLFKQTIYPRQERDVKKSRTLITKKNGLFTDIYGGYTGNVNSYFVLVQTKYKKDPDKFNLYGVPNRYVAMLEQSKSKGNYETKLKEVMEPIIKNSNKRMIGYKILKDRILYNQIIEDNGYKFFITSSQYRHNFRQMILSDQSKKILMDYVFDPNFYRHKKTEDVNNDKDAKLIKVYDEILYQIDHYLQIFTIGHHIDKLKKARPLFEKCTLAEKAQVLNDILIIAGSNQTELALKPLKTTKLTFSKQNCPLTKDAIFYYQSPTGMITRKESIKDILKQNI

SEQ ID NO: 1125 - protein, 1390 aa, Artificial Sequence
  Cas9
MSRKNIVEDYAISLDIGNASVGWVAFTPNYRLVRAKGHELIGARLFEPASTAEERRMARTTRRRYSRRRWRLRMLDSMFDQALSEVDPSFLMRRKYSWVHPEDKNNEAHWFGGVLFDSNEQDKRFYEKYPTIYHLRKSLMEDDERHDIREVYLAIHHMMKYRGNFLTEGELAPSSVFDVEDFLKLLTEILQYADEGETDEDLELQADANGLTEALCTTKGSRSIRAKNAISILKEGAALSKRQEAIISAVFAGLEGNKLDLTKVFPNKEYTPEDKKTLALYFNKADYDEKRVAIGDSGLLEDNECDFLDCIRRQYSAIALKQLLGDFTSISESMCARYEQHQRNWDLIKRYCREESNAENINKNYGALVGWEIVGGQRRSIRGAKDYENKRKAANKFFEELIKGSALPDQEKERLLHDIENDELFPVQRDSGNGVIPYQLHLNELKKIIQKQGRYYPFLLETYIKDGKEVNKLEGLLAFRVPYYVGPLVSRDDMQSSDNRENHWMIRRKKGVITPWNFDEMVDKDKSGHEFIKSLVGTDSYLLGETTLPKNSLLYQEFEVLNELNNVRLSIRTGNHWADKRRVRLGHNEKKLLLEELFAKQATVTKKAAENLLRRTYGNTYEISGLADEKKFVSSLSSYGKMCRTLKASYVNSHKDVVEKIIELQTVFEDKKTLKHQLQLLGELAETNCELLSNTHYTGWGKLSRKLLTSKVVVCKIGNDFAPAKHSIIEIMRETDRNFMEIITDKDLGVGEWINQQNVGAEDGNSYQDIIDDLRVSPKVKRGINQAIRVIDDISKAVGKEPSRIFLELAGDVQQSARTVSRKSRLQGLYKSAGLQKEFRDLAESLNECSDNDLRDDRLFLYYTQLGKDMYTGEPLNLDRLSSDYDIDHIIPQAVTQNDSLDNRVLVARVANARKTDSFQYLPEIANRMRNFWQELLDAGLISRVKFDRLNRQNDFSSHEKERFVQRSLVETRQIMKNVATIMRKRYGNSAAVIGLNSELTKEMRQYLGFSHKNRDINDYHHAQDALCLGIAGQFAVNRGFFANGMVSDGAVNSYNLYLQDYLRGYREKMSAGERRRNKAFGFIVGSMNSQDSDKRINPKTGEIAWDDEDKVYLRKVMNYRKMLITQKVGDSFGALYNETRYGTSAKEGVNGIPFDKHKQDTALYGGFSSAKTVYVVLIEAKKKTRLVNITMQEYAELGDHPSDDALRAVLAKKKPEYGKARILLRHIPPMQLIRYGGALVTVKSATELNNAQQLWLPYKEYCLFDDVISSAIDVDEARLCQMLDVILDAIQKYYPKQRFDETGLSAFHNAFNEVSAEDKKRIVGEMVGMLHADAKNANLKALGMSGRWGRMSNQSGYTFADSDEFIFQSPSGLFEKRISVGELKKRRAR

SEQ ID NO: 1126 - protein, 1390 aa, Artificial Sequence
  Cas9
MKEVKDYIIGLDIGTNSCGYVVTDKQNNILKLKGKTAIGARLFKEGEAAADRRAFRTTRRRLARRRWRLGLLEEIFDEEMAKVDSSFFRRLKESDYSPKDSRKQFNSIVFESSEADKDFYDKYPTIYHLRNALMHDDQKHDLREIFLAVHHIVKYRGNFLREDSVKAFKAAKFTLQGEDGIGPVDKLNDLLKEIYIEAAPELATDNLSKIEEIIKDKKLYKQDKLKQVATLLTKEADTKDKAKLNKDVAKQVANAFMGYMIIFDTIFNLSDVDSKDYKVKFSDANIDEKLDTLTSLLTDKQTEFVLELQNIYNTIVLNEIVPDGKSLSESMVKKYDDHKEDLKLFKAYLNSLTDVKKVKELKAAYVLYVNNRKANLLAAKKLLGKKADNMNNFEIFSKFVADNLDDSELANKIRARLDLGEFLPKQRTNQNGVIPYQLHQVELTQILEKQGKYYPFLIAPNPVESHRNNAPYRISELVSFRVPYYVGPLIDPNNAESEQDKANSSFAWMVRQKQGQITPWNFEEMVDTTESANKFIKRMTTKDTYLLGEDVLPASSLIYQKFVILNELNNIKVNGIKLTSEEKHQIFDELFKVQKSVSLKNLVNFLTAHGCVAPNVTGLSDGTKFNSSYSTYIDYRKIFGAEIDNKDKQADFEKMIEWSTVFEDRKIFKRKLEEITWLTPDQIKQVSSKRYSGWGRLSKKLLTQITDENGVNILQRLWNESENLMQILSDPVIKEKIVAANSSFTKATDMEDILAEAYTSPQNKKAIRQVMRVVDDIIAAAHGKKPSQIAIEFAREDQDNPQMTKSRKAQLDQIYAKISDEFLDNAVKNELKNMKDNKPLAKDKVFLYFKQMGRDAYTGEKLSLDNLQDYDIDHIYPQSFIKDDSFDNRVLVQRAVNNGKSDNVPVLLFGNKQAADLGMTIRQMWKKWLELGLISKRKFNNLITDPEKISSYMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAESKEDDPVKKIKQFNFIYQLLWGKDDAICISHTDQQVFSRSDIINKLTTAYNFKYMNVSQEVYTNSNNVFKQTVFPIIERDTAKSRSLIPKKLDRPTDIYGGYSNNNDAYLALVKVDKKKGSEYRVVGIPMRAAAMLKASKNYDEDLRKVIEPMVMLDKNGKAKRGIEGFRVLVGKMPFKQAVLDGDKKFMLTGTNDMPNLKQLVLSQQNMKYILDYIDDIDCRKHKFGNKTQDGNKCLLEVFDEIIQIVDKHFELFDNRSFREKLRNSRVNFINLALSKKAEALLAILNGLHANSMRTTIKELKISDLGRIQSSVISPEAQLIYQSPTGLFERRVKVKDL

SEQ ID NO: 1127 - protein, 1391 aa, Artificial Sequence
  Cas9
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 1128 - protein, 1391 aa, Artificial Sequence
  Cas9
MKEIKDYIIGLDIGTNSCGYVVTDKQNNILKLKGKTAIGARLFKEGEAAADRRAFRTTRRRLARRRWRLSLLEEIFDEEMNKVDPSFFRRLKESDYSPKDRRKQFNSIVFESSEADKAFYEKYPTIYHLRNALMHDNQKHDLREIFLAVHHIVKYRGNFLREDSVKAFKAAKFTLQGEDGIGPVDKLNDLLKEIYIEAAPELATDNLSKIEDIIKDKKLYKQDKLKQIANLLPKAVDSKDKAKLNKDIAKQVANALMGYMFRLDTLFSFTDVDVKDYKLKFSDANIDESLDALTSLLTDAQIEFVLELQSIYNTIVLNEIVPDGMSLSESMVKKYDDHKKDLKLYKEYIDSLSDQKKAKQLEAAYALYVNYRKADLLAAKKLFEKKKIGDKKFVDVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNFEEMVDTTESANQFIKRMTRKDTYLLAEDVLPKSSLIYQKFMILDELNRIKIDGKKLTSKLKHDIFEKLFKKQKSINLDNLKNYLLAEGNIPGLIEGLSDGINFNNSFSTYIDYRNIFGDEIDNPNKQADFEKMIEWSTVFEDRKIFKRKLKEITWLTPEQIKQVSSKRYSGWGRLSKKLLTQITDENGVNILQRLWNEPETLTEVLANPVIKRKISEANSLFVQINKVENILDDAYTSPQNKKAIRQVIRVVDDIIAAAHGKKPSQIAIEFARSSQNKAKVPDTRKKQLDKIYNKISSEILDSSIKNELKNLKSNKYLSKDKLFLYFKQMGRDAYTGDKLSLDQLQNYDIDHIFPRSFIKDDSLDNRVLTQKPINAKKSDYGIPALEFGNKYVPDLGITVKEMWKLWQENGLISKSKLINLCTNPKKIGSKRASGFINRQLVETSQVIKLVAIILQAEFPDTEIIEVKALQNTTLRESFHLYKNRSVNDYHHAIDAYLTTIVGNYLYQVYPKLRPYFVYGQFKKFNQEKNIDILKRLKNFNFLRQLIFNTDDNIYISGTKEIVFNKKDIIHKLETAYGYKYMNISRECYQETSSLFNQTLYAHNSSVKNSLIPKKKGLPTEIYGGYSGNKDSFFVLVKIVKKRTNLYRIVGIPTRELAKLNSSNNYNQALNKIVESKLCLKETESFKILIKRLLYGTLIVDNGQKFRIGSFKEKHNVQQLVLQLKSMKYIKFYIDGGQNYFTDVERKKLEKQDRDKCLLYVFDDIMNVVNKRFTLFDMSKYEKDGDSLREKFNCLDFNDKVSILSDLLKAFHANSDRTSITKLKITNLGRHQAGKNGITLTTNAQIIYQSPTGLFERRIKIKDL

SEQ ID NO: 1129 - protein, 1391 aa, Artificial Sequence
  Cas9
MKKILGLDLGTNSIGWALVNEAEHEHEQSSIVKLGVRVNPLSVDEKTNFEKGRPLSINADRTSKRSARRNLQRFKLRRKNLINLLLKHHIISNETILTEVGKNTTHQTLKLRSKATQEKISLEEFARILLSINKKRGYKSSRKEKNEDEGFTIDGMAIAKELYDNQLTPGQYVYNILQDGKNYIPDFYRSDLQAEFDDVWQFQKKFYSSILTDEFYLKLKGQGKENTRKLFLAIHQVYTAENKGKRDAVKLQYYKWRSEAVKKQLSIEEVAYVLVEINNNINKSSGYLGAISDRSKALYFNNETVGEYLYGQLVKNRHNSLRNQVFYRQDYLDEFEKIWETQAKFYDELTNELKQEIRDVVIFYQRKLKSQKHLISDCLFEKHHKAIPKSSPLFQEFKIWQNLNYLEFVHTQSKEKIFFSELDDETRQFVFAELNIRGTLKIKEIKKLIGLETPVYWKSNFDEIEGNRTNQVLYNVYQNIADDLGYGFDWSKKHAFEINAELQAIFKDVGIDTAILNFDASIEENDFDKQKSYQLWHLLYSAEDTDKATEEDKLIYGNINTKLKKQLHQKYGFEAKYGNLLANISLQQDYGNLSAKAIKKILPYLESGNSFYEACTIVGYNPSNSLTKEQQQNRKLKDKLELLPKNSLRNPVVEKILNQKVNLINQLIDEYGKPDEVRIELARELKKSAKQRADLSKHINDATLKNQNIRKTLQKDFGIQNPSKNDVIRYKLYDELKDNGYKTLFTNKYIPKEQLFSKDVDIEHIIPKAILFDDSFSNKTLAYRNVNLAKADATAFDFISSKHLDDLDNYKARVETLFQSKRISKGKYKKLLMTRQNLPEDFIERDLRNSQYIAKKATAMLKEVFRSVVPTSGRITDKLREDWDLVNVMKELNLPKYRTLGLTEFIERKNGNKIEQIIDWTKRNDHRHHAMDALTVAFTTHNHIQYLNNLNVTHGLNGVDTDHEKSRLYAIKQAITKVYIVGKTKKRKFIPPMENFRSHAKNHLEGILISFKNKNKVVTKNKNRTKTKTKGVFNEKIQLTPRGQLHKETIYGHAKKVIVTKEKVSSKFTHEKILQVTKPAYREALLKRLASFKNDPKKAFSGKNALSKNPLYFDITSGKKVPDTVKLSYFENSYVIRKEVNSDNFKNEKSLQKVLDVGIRRILEKRLADYNGNAKEAFSNLEKNPIWKDKEKGVCIKKVRIEALKNAEPLHVKKDHLGKIILDDENKSTPVDFISTGNNHHVAIYEDKDGKLHDKVVSFYEVVSRVNLGLPIIDKSFNSHLDWKFLFSMKQNEMFVFPSEDFNPKEIDIGNPKNNELISKYLFRVQKFSKVTYGNSAVRDYVFRHHLETELIDKKELKGITYYQLKSIGMLEKLVKVRINHIGKIVHIGEY

SEQ ID NO: 1130 - protein, 1391 aa, Artificial Sequence
  Cas9
MKTILGLDLGTNSIGWALVKEAENENEVSDIIKLGVRVNPLTVDELTNFEGGKAYSNNAERTLKRGARRNLQRYKLRRENLIEILLKNGLINKDTALTEVGKETTHQTLKLRSKSANEKVSLEDLAKILLSINKKRGYKSSRKVNAEDDGVAIDGMEVAKLLYDENMTPGEYVLRLLESGKKHLPDFYRSDLQEEFNLVWKKQSEFYPLILTKELFFELHGKNKSQTWAICKEPLGIVGVKLKGSAKEQKFARYRLRKEALTQQIELEHLAIVLQDINNDSNKSSGYLGAISDRSKELFFNKETVGQYQYKQLQKDPNTSLKNQVFYRQDYLDEFEVIWRNQAKFYPQLTNELKQEIRDVVIFYQRKLKSQKNLISFCQFESTQQNYVEKETGKTKIRTIGRRVIPRSSPLFQEFKIWQSLNNLKFVNSESNQIIQFIELEDDVKKVVFDELNLRGDLKPNQVLKILSKYMKIGKLTQWKCNLEEIEGNRTNSALYNVFQMIAEEEGYGFNWGKKSALEIKSELKAIFSSIGINDSILDFDFSKKLDQQLSYQLWHLLYSAEEGNSKITEEDKFTYGNTGVALKKKLHLKFGFKPEYSTLISNLRFTSDYGNLSSKAISKILPFLRDGSDYSKACQYAGYNHSNSLSADELDNRELKPKLELLKKNSLRNPVVEKILNQMVNVVNQVIDNYGKPDEVRIELARELKKSAKERSQMTKNISDATRRNAEIKKYLSKEFGIPNPTKGDVIRYRLWEELASNGYKDLFRDKYIPKEKLFSNEIDIEHIIPKALLFDDSFSNKTLAFKVDNLKKADRTAFDFMSTDFSKDVDSYIGRIETLHKDGKISSSKYKKLMIPKSKLVDGFIERDLRNTQYIAKQARKMLLEVFKTVVPTTGKITDKLREDWDLINVMKELNFPKYKALGLTKKIERFDVGSEKIKSINVIEGWSKRNDHRHHAMDALAVAFTTHNHIQYLNYLNARKDIHHEMHGTIKSIENQIIGKDVMGKRRFIPPISDLRMKAKLQIESILISFKNKNKVVTWSVNKTKLKGKDNYNKRRQLTPRGQLHKETVYGKIKLIDPKPLKLNNKFTLVRASMIVDKVHREIVLQHLSKYDNNSEVAFDSKTIKIDPILIEGIGLKEVVCYEDVFKIRKKISGDNFKNEKHLEKVIDEKVKQILKDRVIKFQGNFKEAFSNLEENPIWLNKSKGIAVKSVAIKGVNNAESLHEGKDHFGDQILDKNKKQIPVDFVSTGNNHHVGIYEDKDGNLQERVVSFFEAVTRVNEGLPIIDKTYNSDIGWKFKFTMKQNEMFVFPSDDFDPNEFDLTDGKNAAKISPNLYRVQKIATKNYMFRHHLETVVTNDLEFTYKSIRSTGWLRNLVKVRINHLGEIVYVGEY

SEQ ID NO: 1131 - protein, 1391 aa, Artificial Sequence
  Cas9
MKKILGLDLGTTSIGWALVNEKENNEELSSIIRLGVRVNPLTVDEKSNFEKGKDITTNADRTKCRSARRNLQRFKLRREALADCLKRHGLMTDETPLCETNNSIIFKTYSNRAKAVCEKIALDDFVRVLFMINKKRGYKSSRKLNTDDEGTLVDGMDVAKLLYNEQITPGEYLLRLFKKGKKTRPDFYLSDLKAELERIWDFQRTFYPEILCNALKEDLKGKSRTQSSAIFYAKYKVSTAKIAGKDKRLQELTWRTDALRKQLTIDEVAYVICSINGEVNGSSQRLSMISDRSKLLYFNHQTIGQYLMQRLEENPNAGLKNIIFYRQDYEDEFNDIWNSQATYHKELTPELKKEVKDIIFYQRGLKSCKWLINYCELEHEEIEVKTPEGKLRKITIGSKTCPKSSPLFQEFKIWQVLNNLQVSPLNSRRKAKRKKDEEPSLFSDEDMNTACRYLNEEEKLTLFKELSIKKELKKKDALKLLFENYKELDLNYKVISGNVTMANLYRAFQDIISLTGNGEFDFQAMPAEEAEKTVEEIFGGLGYKTAFLHFDASLHDKEFERQPAYRLWHLLYSYAGDQSKTGIEALVKRIQELCGFEPEYARILANISFIPDYGNLSSKAMRKILPYMQDGYEYSEACSKAGYRHSASSLTKEEINKKNYKTHLDEIKRNSLRNPIVEKILNQMVNVVNSVIDTYSNIDEIRIEMARELKKSKPEREDMSFAISKATKETERIKGILEQEFKIQHVTRNDIIRYRLYEELKPNGYKTLYSNTYIPREDLFSKKFDIEHIIPKARLFDDSYSNKTLELRDINIEKGNQTAYDFVLSKYGEEGLYKYEQRVEEFKKNNEQAGTKCRKLLMREADIPSDFLNRDLNDSQYIAKKAHELLREIVPTVTATTGSITNRLREDWKLVNVMKELNWEKYDKLGLTEEYKDKDGNTVRHIKDWTKRNDHRHHAMDALTIAFTKPSFIQYLNNLNARSNRGGSIYGIEQKELERENNKLVFIPPIDPKIFRKQAKEHLSNILISIKAKNKVVTKNVNKTKSKSGTNRKVQLTPRGQLHLETVYGKIRTYKTEEIKVGTKLTEELIAKVADKKIREALMQRLSEYGGNIKKAFQNISKHPIWLNGSHTKHVPEKVKIVFFEDVFTIRKAITPDIKIDKVIDSKIRRILQERLNEFGGEASKAFSNLDENPIWFNRDKGIAIKSVKIRGIAKGTAIRVKKDIHGKTIIGNNGYPVANDYVNTGNNHHVAIFRDKDGNLQEHIVSFYEATARAIQNLPIVDRNYNSEKDWKFLFSMKQNEYFVFPNPNTGFNPSEISLKDEKNYALISPNLFRVQKLSHYYYVFRHHLETNVDTNLQLKDITWKRITAVNNLTGAVKVRIDHLGRIVDVGEYK

SEQ ID NO: 1132 - protein, 1391 aa, Artificial Sequence
  Cas9
MKNYHIGLDIGTSSVGFAARDDDNNLIRVKGKNVIGARLFSEGQTAQERRMARTSRRRYNRRKWRLRLLDEIFHDEIIHKDAEFFNRLKQSFLSPKDERKQYFGSLLFPETGDSEYYHNGNQTIYHLRHRLITQDEKADIREIYLALRHIIKYRGNFLDDTPVSSFEASDLKLASFVPTINDLFETIDVNYEFSMDNINEIEDILLNNKLRNSDKSKQLTDLLTEPIVNIDDKSLEKQFNKERTDISKEIAKSVVGSKMNVNKLLSFESSEGSKIAFSFSDASSEDKMMELSDILDDSRMNILNILKVIYSRVRLNQIIPSGMGLSESMVAAYDSHKQQLKDLKTLLNVLPFNERYAVKIAYAAYIGNIDKQKFTKSEIKAIDKLKEKSAIMNVLDFKSGHITNEELSNVIKAVIVDKYLNDEDFEYHGIVEKINQDISNGSYLLKQRNNQNGNIPHQLHQMELDQIIENQSKYYHFLGELNPNSNRNHIAKYKISELVAFRVPYYVGPLITPEEQEKTSGASFAWMKRKKDGAITPWNFEEKVDKEETASRFIKRLTVKDTYLLNEDVLPDNSLLYEKFKVLNELNVVKANNKRLTVEEKQGAFDNLFKKMKTVTAKRLKNYLVSNHNHINSVEITGLSDGDKFNNSLSTYIDFKKIFGDKIDNPGLLDDFEDIIEWSTVFEDRKIFEEKVRKDISWISESEIKSVVSKRYSGWGRLSKKLLNCITNNEGRNIIDELWEESETFMEAVSKPEVKEQIDGINSDFIKNTDIESVLADAYTSPQNKKAIRETHKLVKDIQKAMGGQAPASISIEFTRNPQDKGQLTRSRHSEVSRKYKEISKEISKTLNDELKSKKNSMDVDKYYLYFMQMGIDLYDGSSIDIDDLNNYQIDHIIPQSFYKDDSFDNRVLTHYSNNQKKGNNTPLNGLNINDKTRAIWNHLRDLGLITKKKYNGLTLKGMDQLSKYTKHGFIRRQLVETSQVIKLVANILSDEFSTDDTKIIEVKAKMNSQIRQVFNLYKVRELNDYHHAVDAYLTTFIGGYLYNRYPNLRNMFVYGDFKKFSADVDNLKTFNFLHEITNPSDKFEDRIFDEKSGELILDRKHAIETIKKIYQYKYMLITREVSTKNGQLSDQTVYSAKRINNVKAPIPVKKDFNPELYGFRTGNVDHHMVIVKYPKKDSYDYKVVGIPLRFVQKLKETKDNKDYENLLNQIVQMKLNRKKQDFIVVVDNVMYGQLIQDGGQKFTLGSSTYRYNAKQLVIDNGYLKLIADERYKNSLTDEEKSNQYITLYNEILKVVNGRFDVFDVNSFRKKLNNGVDKFIKLNTVDKRIIIMKILSGLHCGPSIVPLKELGLTTPLGQLQSTSGISLSENTIIIYQSPSGLFERKVRLGDL

SEQ ID NO: 1133 - protein, 1391 aa, Artificial Sequence
  Cas9
MKNYHIGLDIGTSSVGFAARDDDNNLIRVKGKNVIGARLFSEGKTAQERRISRTSRRRYNRRKWRLRLLDEIFHDAIVHKDAEFFNRLKQSSLSPKDERKQYFGSLLFPEVGDGDYFRDGNQTIYHLRHRLMTQDEKADIREVYLALRHIIKYRGNFLDDTPVSSFEASDLKLASFVPTLNDLFETINVNYELSIDNVNQIENILLNNKLRNSDKSKQLTDLIAEPVTNIDDKSLKKQFDKERKDISKEIAKAVVGSKMNVNKLLSFESSDGSKISFSFSDASSEDKMLELSDILDDSRMNILNVLKVIYSRVRLNQIIPSGMGLSESMIAAYDLHKQQLKDLKTLLDVVPFNEKYAVKIAYAAYIGNIDKQRFTKAEVKTIDKLRDKKSITSVLDFKSGHITNEELNNVIKEVIVDKYLNDETFEYHDIVEKINQDISNGNYLLKQRNNQNGNIPHQLHQMELDQIIEKQSKYYPFLGKLNPNSKRSHIAKYKISELVAFRVPYYVGPLITPEEQEKTSGASFAWMKRKEDGAITPWNFEKMVDKESTASRFIKRLTVKDTYLLNEDVLPDNSLLYEKFKVLNELNVVKANNKRLTVEEKQGAFDNLFKQMKTVTAKRLKNYLVSNHNHINSVKITGLSDGEKFNNSLSVYIDFKKIFGDKIDDSKLFDDFENIIEWSTVFEDRDIFEEKVRKDISWISESEINAVVSKRYSGWGRLSKKLLNGITNDEGRNIIDELWEESETFMEAVSKPEVKEKIDEINSNFIKNTDIESVLADAYTSPQNKKAIRETYKLVKDIQKAMGGQAPSSISIEFTRNPQDKGELTRSRHSEIAKKYKELSKEVSKKLNDELKSKKNSMDVDKYYLYFMQMGIDLYDGTSIDIDDLNNYQIDHIVPQSFYKDDSFDNRVLTHYSNNQKKGNNTPLNGLNIDSNTREVWNHLIGLGLITKRKYNNLTLKGMDQLSKYTKHGFIRRQLVETSQVIKLVANILSDEYSKDDTKIIEVKAKLNSQIRQVFNLYKIRELNDYHHALDAYLTTFIGGYLYNRYPNLRNMFVYGDFKKFSAKIDNLETFNFLHDITNPSDKFEDRIIDEKSGEVILDRRHAIETIKKIYQYNYMLITREVSTKNGQLSDQTVYSARRINKVNSPIPVKKDSNPELYGFRTGNVDHHMVIVKYLNKDKYDYKIIGIPLRFVQVLKNSNDNTEYKNILNKIVQSKLKGKSTDFRVILDNVMYGQLIQDGGQKFTLGSSTYKYNAKQLVINMDDIRILVDNRYFNSLSDDDASGEFIKIYNEILKVINARFDLFDINKFREKLNNGKEYFENLSIDEKNQVLLKMLSGLHCGSANVPIKELGLTTPLGKLQIPSGIVLSEDAIVIYQSPSGLFERKIRLKDI

SEQ ID NO: 1134 - protein, 1391 aa, Artificial Sequence
  Cas9
MNLRNYPGEYSIGLDMGTGSVGWSVVDEKGNLLHFKKKPTWGSRLFDSVMPASEARVHRGQRRRYERRRWRLDLLQGLFKNEMNKVDPEFFMRLNQSRTIEGDPIFTKSFTKADYYDRFPTIYHLRAYLMESNEPADLRLIYLAMHNIIKHRGNFLREEEKSLSAKHADSKKAVTQFVDALKEWCFSRGYEFGKDPAKSIEKCLSDSKSSRSQLASEIAKALAVSTDAAAADKKLADNLAKAMVGLQCEFKYVFGEFDCESTKLALSDDEKLELLRAACPDDSVELLDALCAVYSAYVLQGLLSYAPGQTISHNMIAKYDLYKTDLKTLRALVREYAPGAYDEFFRGATYHDANPDDSSKDYSYADAEGYTAYNLHKLSYDDFAKAVKKLLGGTDAVTDERYLNMMERFEKQQFLRRLKTSDNGAIYYQLHLEELTAIIKNQGRFYSFLKEYEGKFESLVSFRIPYYVGPLTSVNAAQDSHNHNRFQWSERKPGMEREVITPWNWDTIIDKNKSAENFIMRMTGDCTYLAGEKVLPKQSLLYEEFCVLNELNGVRWSDDGDDWQRFDAAQREGIVRELFHKYRRVTYKMLEDWLVREGDANHPIVKGGQGETGLESKMGSYLFFAKGIFGLGELSPAEYPAIEKMIKWNTLFEDRSILKEKLEDEFGERGNGMLDASQIKAICKKRFTGWGRLSEQFLTGLKVESPAGRAVSIMDVLREGNPCSERRQGETVVMMEALRDEGLGFQKKIDEHNRNYYGQHGKDLGVNELPGSPAIRRSLNQAIRIVEEIASIAGHAPANIFIEVTRGEDAGKKGKRTVKRWDKIGEALKKLKEEGVAVEVMDDFKEQKAINANLDERLSLYLMQNGKCLYSGKAINLEKLLAGSGEYEVDHIIPRAYIKDDSIENKALVLREENQHKTDQLLIDKSIRWKMRETWSQLHDAGLIGDKKYHNLLRSNINENQLRGFIARQLVETSQMVKLAQALLEARFANEETRIVPVKASMSHNLREAADLAKCREANDFHHAHDAFLASRIGLFVQMRHPGIYENPIGYSHVIKKYVQEQSEVFKKTHRMPGSAGFVINSFMSSGFDKDTGEVFKDSWDAEAEVDGIRKALNYRQCYISRMPQQDTGAFWNATVYSPRDPKMGPKLALSTKQGLDPKLYGGFSSQQFAYFFIYEAKKKGKPTFRFSQVPVWLAARIEANPLALEEYARGLAKGEGLEFVSIQRPKIYKKQLIEVNGDKLIITGAKEVRSGAELAFNQDEISAISMCSKLRAAEAGLDGAFSEEVSAIWNRISNAPVQSCGRLLRQLTLPKYQSNFDSSSNEEKAAVVLGLIALLNGNNRIVDLSGVGGSSHAGAMMMSYPKLLDDPKVPFFIIDQSVTGMFERKTRVGL

SEQ ID NO: 1135 - protein, 1391 aa, Artificial Sequence
  Cas9
MKKILGLDLGTTSIGWALVNEKENNEEQSSIIRLGVRVNPLTVDEKSNFEKGKDITTNADRTKCRSARRNLQRFKLRREALADCLKRHGLMTDETPLCETNNSIIFKTYSNRAKAVCEKIALDDFVRVLFMINKKRGYKSSRKLNTDDEGTLVDGMDVAKLLYNEQITPGEYLLRLFKKGKKTRPDFYLSDLKAELERIWDFQRTFYPEILCDALKEDLKGKSRTQSSAIFYAKYKVSTAKIAGKDKRLQELTWRTDALRKQLTIDEVAYVICSINGEINGSSQRLSMISDRSKLLYFNHQTIGQYLMQRLEENPNAGLKNIIFYRQDYEDEFNDIWNSQATYHKELTPELKKELKDIIFYQRGLKSCKWLINYCELEHEEIEVKTPEGKLRKITIGSKTCPKSSPLFQEFKIWQVLNNLQVSPLNSRRKAKRKKDEEPSLFSDEDMNTACRYLNEEEKLTLFKELSIKKELKKKDALKLLFENYKELDLNYKVISGNVTMASLYRAFQDIISLTGNGEFDFQAMPAEEAEKTVEEIFGGLGYKTAFLHFDASLHGKEFERQPAYRLWHLLYSYAGDQSKTGIEALVKRIQELCGFEPEYARILANISFIPDYGNLSSKAMRKILPYMQDGYEYSEACSKAGYRHSASSLTKEEINKKTYKTHLDEIKRNSLRNPIVEKILNQMVNVVNSVIDTYGSIDEIRIEMARELKKSKPEREDMSFAINKATKETERIKGILEQEFKIQHVTRNDIIRYRLYEELKPNGYKTLYSNTYIPREDLFSKKFDIEHIIPKARLFDDSYSNKTLELRDINIEKGNQTAYDFVLSKYGEEGLYKYEQRVEEFKKNNEQAGSKCRKLLMREADIPSDFLNRDLNDSQYIAKKAHELLREIVPTVTATTGSITNRLREDWKLVNVMKELNWEKYDKLGLTEEYKDKDGNTVRHIKDWTKRNDHRHHAMDALTIAFTKPSFIQYLNNLNARSNKGGSIYGIEQKELERENNKLVFIPPIDPKIFRKQAKEHLSNILISIKAKNKVVTKNVNKTKSKSGTNRKVQLTPRGQLHLETVYGKIRTYKTEEIKVGTKLTEELIAKVADKKIREALMQRLSEYGGNIKKAFQNISKHPIWLNSSHTKHVPEKVKIVFFEDVFTIRKAITPDIKIDKVINSKIRNILQERLNEFGGEAAKAFSNLDQNPIWFNKDKGIAIKSVKIRGIANGTAIRVKKDIHGNTIIGNNGYPIPNDYVNTGNNHHVAIFRDRDGNLQEHIVSFYEATARAIQNLPIVDRNYNSEKDWEFLFSMKQNEYFVFPNPNTGFNPLEIDLRNEENYALISPNLFRVQKLSHYYYVFRHHLETNVDTNLQLKDITWKRIKAINNLTGVVKVRIDHLGRIVDVGEYK

SEQ ID NO: 1136 - protein, 1391 aa, Artificial Sequence
  Cas9
MKKRIDDYILGLDIGTNSCGWAVTDKKNNLLKLRGKTAIGSHLFEEGHTAADRRGFRTTRRRLKRRKWRLRLLEEIFAEPMAEVDPGFFVRLHQSWVSPLDKSRKKYQAIVFPTAKEDQEYYQKYPTIYHLRDALMTQDRQFDLREIFLAIHHIVKYRGNFLQDTAVKDFEASKIEVGPILTNINNAFADKIVEGQDLIELNVANAAEIEAVIRGKDADKTLYKMDKVKKIAKLLTDSTAKEQKNVAKQIANAIMGYKTQLETILGKEIDKNDKAQWEFKLSDADDKLDALLPDLDESDQTVVAEIEKLFSAITLSTIVDENKSLSQSMVEKYNKHHQDYKLLKAYIESLPDRAQAKKLLLAYDLYVNNRHGHLLEAKTEFKQDSTLTKEDFYKTVKDNLDDSELAHKIAQEIAADNFMPKQRTNSNGVIPFQLHQIELDKIIANQSKYYPFLAAENPVEDHRKQAPYKLDELVRFRVPYYVGPMITADEQEKTSGKSFAWMVRKEQGQITPWNFEQKVDRQESANKFIKRMTIKDTYLLGEDVLPANSLLYQRFEVLNELNNIRVNGSRISVDLKQQIFNDLFEEKKTVTEKALISYLKQNLHLPTVEIKGLADPTKFNSSLASYYHLKNLHVFDKELADPQYQKEFEKIIEYSSIFEDKKIFQDKLHAEFKWLTPAQFKAISTWRLQGWGRLSRKLLVELHDTNGQNIIEQLWDSQKNFMQIVTEPDFKEAIAKENQNITQENGVEEILADAYTSPANKKAIRQVVKVVADVVKAASGKAPAQFAIEFTRDPDKNPQLSHIRGTKLLKAYQETAGELVDQNLTNSLKEAMTSRKLLKDKYFLYFMQTGRDAYTGKKINIDEVSTNYQIDHILPQSFIKDDSFDNRVLTATPLNAEKSDDVPYKRFANNYVSDLKMTVGEMWKHWQKAGIINKHKLGNLLLDPDRLSKFQKSGFINRQLVETSQIVKLVSVILQNKYPDAEIITVKAGDNSALRQRLDLYKSRDVNDYHHAIDAYLSIVCGNFLYQVYPKYRPYFVYGQFKKFSQDPDLQKDLIKHFKGFTFMWPLLQKDNSERKALEEIKENNSDRIVFYKHPDIFDKLRKAYNYKYMLVSRETSTESSSMFNMTIYPRGERDRKKTRKLIPKGNGLDPKIYGGYSGNTDAYMVIVKIEKAKESIYKVIGIPMRALAGLKQAKNQGNYKEELHKVVEPQIMLDKNGKPKRGVEGFRVVKDHVPFKQVVLDGDKKFMLYSAKYETNAKQLTLSQETMRIVTDNLKKSEDQDKLLVKAYDEILQKVDQYLPLFDVNKFRNSLHLGRAKFLDLAVNDKKITLSNILNGLHDNLVVPNLKNIGIKTPFGLMQSPSGITLSSNAILIFQSPTGLFEKRVRIADL

SEQ ID NO: 1137 - protein, 1391 aa, Artificial Sequence
  Cas9
MENKQYYIGLDVGTNSVGWAVTDTSYNLLRAKGKDMWGARLFDEAKTAVERRTKRTSRRRSEREKARKAMLKELFADEINKVDPNFFIRLEESKFFLDDRSENNRQRYTLFNDAKFTDKDYYEKYKTIFHLRSALINSDEKFDVRLVFLAILNLFSHRGHFLNASLKGDGEIQGVDIFYNDLYEVCEEFEIDLPQISNIDNFEKILSQKGKSRTKILEELSEELSISKKEKIKYSLLKLICGMKIKVVDIYADEDIQEDDKKKDLGFRESDYEKSSLEVKEIIGDDHFELIERAKAVHDIGLLANIIGNSKYLCEARVEAYDNHHKDLQKIKELLKKYDIKAYTDMFRKMTDKNYSAYVGSVNSNIAKERRSVDNRKIEDLYEYIKKIALKNISDDNEDKIEILKKIETGEFLKKQLTASNGVIPNQLQSRELRAILKKAENYLPFLKEKGEKNLTVSEMIIQLFEFQIPYYVGPLDKNPKKDKNANSWAVIPSGGRILPWNFEDKVDVKGSRKEFIEKMVRKCTYLSEEHTLPKQSLLYEKFMVLNEINNIKIDGEKISVEAKQKIYNDLFMKGKKVSQKAIKQELISLNIMSKDSVLSGIDTVCNAYLSSIAKFRGVFDENVNNQSTIDMIEDIIFLKTVYSDEKRFVKEEIVEKYGDEIDKDKIKRILGFKFSNWGNISKSFLELEGADVGTGEIRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYSAIKEDSKQWVKELDAKDESYFRSKKMYLYYLQKGRCMYSGEVIELDKLMDDNLYDIDHIYPRSFVKDDSLDNLVLVKKEINNRKQNDPITPQIQASCQGFWKVLHEQGFISNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPAYKYHMDRFFERDVKSKSEVAWIGQSEGNAGTIAIVKKTMSKNSPLITKKVEEGHGSITKETIVGVKEIKFGRNKVEKADKTPKKANLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 1138 - protein, 1391 aa, Artificial Sequence
  Cas9
MKRNNDYYIGLDMGTNSVGWATTNPQGRLLRFNKKDMWGSRLFEEAKTAAKTRTFRTSRRRYDRVRQRIEFLQDIFAPIIAKKDFEFFMRLKESKFHLEDKKTDGKFALFNDADFTDVEYFDRYPTIYHLRAALIKPNHITDPRLLYLAIHHIIKNRGHFLFAGTDMESIRSFQIVYTQLSEHLKSINLDFELPVDAQDKFAAILLNEKLNKRDKKKQLKELCPHKDKRLEYAFNAIIGGKTKLKDIFGVEEYDEGTKKAVDFEKADYDEDKDEIESVIKENIHVLNALKAVYDWTILTNILGDYAYISESQVALYEAHKKDLRILKSLIKKYAKSQYADAFRHENVKGNYANYVGSTNYDNKQPVIDNPSVTQEDINKYFADILLSITPDESDRESYQYITERLHKGEALPKLRTKANSVLPHQIHKIELEKILANAAKNFPFLQEKDSSGYTAAQKIVKIMMFRIEYYVGPLNTYHHVDQGGHAWMVRKAEGKITPWNFDEKVDKEASAEKFIRNMTNKCTYLIGKDVIPKQSLLYSRYKVLNELNNLKVNGAPISVALKQKIYEELFKKQVNVTFNQLKTFLKTQGEDADEIILSGVDEAAHKFTNNLQTYHKFRAILRDKIEFEPQRSMVEDIIRWKCLMGDDITMWKHKIEKEYGDQLSEEQLKKITRLNFNGWSRLSQEFLTDVPGVDIESGEVYSGIMDALWRTNENIMQLLSSRFTFAAEVKKQNQGTGRIEKITYDEVMKDTYLSPAVKRSVWQAITLVEEIRKIRKADPKRIFVEMTRQPDAKKERKLSRRTQLLNAYRAIGNDIAEYEKEHVSTLITQLESKKDEDLRRKKLYLYFTQMGRCMYTGERIDLSSLLRDTNSNIYDIDHIYPRSLTKDDSLDNTVLCKKEINLKKGNKYIHRVFTDKELKKQYGYWKALKEKKLISERKFSRLMRTTDLTADELAGFISRQLVETSQMVKATADILEKIYPNVTIVYVKARTVSDFRHDYELPKVRALNDCHHAHDAYLNIVVGNVYYEKFTKSPFRFIANQKGKGDIKYNLYRLFDKDVKVGDRIIWNAKEDLARVKATLERDTVNVVRMPVEQRGQFFDATIQKKGTTKNMLVLPLKGSDERLQDTSKYGYYVRPSGMSFMVVQHEVKGKSRVTIEPALLVYKNKLKSEDDYAKYCEDVLKLQKPKVLFKNIKFGSKILFDGYPFLLKGRTENRIIMADAQSLFLGNQELKILKRVTKISDDIDHKVESRIKITDEEWTTLWKSVVEQIVTGKFRNRLGTLNGILQGRKIKLSKDEEARLNELDSKDQETFLSQILLERFLQFSTEEKTRLLLQVISFSGNTTGVDLRLIGGSSGTGTIKTNKNITDHSVILINESPTGLFTNRTVLNQP

SEQ ID NO: 1139 - protein, 1391 aa, Artificial Sequence
  Cas9
MKRNNDYYIGLDMGTNSVGWATTNPQGRLLRFNKKDMWGSRLFEEAKTAAKTRTFRTSRRRYDRVRQRIEFLQDIFAPIIAKKDFEFFMRLKESKFHLEDKKTDGKFALFNDADFTDVEYFDRYPTIYHLRAALIKPNHITDPRLLYLAIHHIIKNRGHFLFAGTDMESIRSFQIVYTQLSEHLKSINLDFELPVDAQDKFAAILLNEKLNKRDKKKQLKELCPHKDKRLEYAFNAIIGGKTKLKDIFGVEEYDEGTKKAVDFEKADYDEDKDEIESVIKENIHVLNALKAVYDWTILTNILGDYAYISESQVALYEAHKKDLRILKSLIKKYAKSQYADAFRHENVKGNYANYVGSTNYDNKQPVIDNPSVTQEDINKYFADILLSITPDESDRESYQYITERLHKGEALPKLRTKANSVLPHQIHKIELEKILANAAKNFPFLQEKDSSGYTAAQKIVKIMMFRIEYYVGPLNTYHHVDQGGHAWMVRKAEGKITPWNFDEKVDKEASAEKFIRNMTNKCTYLIGKDVIPKQSLLYSRYKVLNELNNLKVNGVPISVALKQKIYEELFKKQVNVTFNQLKTFLKTQGEDADEIILSGVDEAAHKFTNNLQTYHKFRAILRDKIEFEPQRSMVEDIIRWKCLMGDDITMWKHKIEKEYGDQLSEEQLKKITRLNFNGWSRLSQEFLTDVPGVDIESGEVYSGIMDALWRTNENIMQLLSSRFTFAAEVKKQNQGTGRIEKITYDEVMKDTYLSPAVKRSVWQAITLVEEIRKIRKADPKRIFVEMTRQPDAKKERKLSRRTQLLNAYRAIGNDIAEYEKEHVSTLITQLESKKDEDLRRKKLYLYFTQMGRCMYTGERIDLSSLLRDTNSNIYDIDHIYPRSLTKDDSLDNTVLCKKEINLKKGNKYIHRVFTDKELKKQYGYWKALKEKKLISERKFSRLMRTTDLTADELAGFISRQLVETSQMVKATADILEKIYPNVTIVYVKARTVSDFRHDYELPKVRALNDCHHAHDAYLNIVVGNVYYEKFTKSPFRFIANQKGKGDIKYNLYRLFDKDVKVGDRIIWNAKEDLARVKATLERDTVNVVRMPVEQRGQFFDATIQKKGTTKNMLVLPLKGSDERLQDTSKYGYYVRPSGMSFMVVQHEVKGKSRVTIEPALLVYKNKLKSEDDYAKYCEDVLKLQKPKVLFKNIKFGSKILFDGYPFLLKGRTENRIIMADAQSLFLGNQELKILKRVTKISDDIDHKVESRIKITDEEWTTLWKSVVEQIVTGKFRNRLGTLNGILQGRKIKLSKDEEARLNELDSKDQETFLSQILLERFLQFSTEEKTRLLLQVISFSGNTTGVDLRLIGGSSGTGTIKTNKNITDHSVILINESPTGLFTNRTVLNQP

SEQ ID NO: 1140 - protein, 1392 aa, Artificial Sequence
  Cas9
MKSILGLDLGTTSIGWALVKESENDNEKSEIVKLGVRLVPLTTDERTDFEKGKSITTNADRTSKRSMRRNLQRYKLRREALVSELKKEHWIDEGYRFSEDGPGSTFSTLRLRAKAAEEEISLQDLAKVLLQINKKRGYKSSRKLNSAEDGQAIDGMSVAKVLYDRGLTPGEYVYQRMLDGQYAIPEFYKSDLQAEFDKIWNLQKSYYPELTAELYDKLTDKNKSQTWAICRDELGVQGFKSSFTGKERLKEAYFNRQQASKQKVDLEVLTCVLQDINGQKASLSGLLSAISDRSKELYFNRMTVGQMLVRQIQEDPNRSLRNTVFYRQDYIDEFEKIWSVQSRFHPELTQERKKKLKDIIIFYQRPLKSQKGLISLCEFESREVDISVDGVIKKKKIGPRVCPRSSPLFQEFKVYQTVNNILVNGEPLDDNDREKLVGELAFREKMKGQDVLKLLYKTSKGMRINFEEVEGNRTMATILKACEKIVEGLGYDTRDLSKITASEKVSRIEEIFAKEGFKSDFLHFDSSLPSPEFESQASYSLWHLLYSYENDKSVSGNESLVEKIKKLCSMDEASAKILSGCTFLSDYGSLSARAMRKILPYMKDGLEYSAACAMAGYRHSKRSLTKEELDSRVYVDRLELLPKNSLRNPVVEKILNQMINVVNSVVDTYGKPDEIRIEMARELKKSASEREKAQKDIAAASKVNESIVATLKGSPFFIDSPSRNDIIRYRLWEELKPNGYKTLYSGTYIPKERLFSKDFDIEHIIPQALLFDDSFANKTIESRQCNIEKSNRTAMDYVKSKYDSFGVQAYIDRVKGLTGVSKTKITRLLMESKDIPEDFINRELRDSQYIARKAREILESMVKFVVPTTGSVTARLREDWQLVNVMRELNWDKYEKLGLTSFREDRDGREIPVIEDWTKRNDHRHHAMDALTIAFTRRQFIQYLNHLNAKIDTVDKTDIDLRDYNLEDISFDGLRDGDKFGIVKALQKKYLYKDDKQKYRFVPPMPLDEFRIEAKRQIEDVLVSFKAKNKVCTKNVNTTKVRGGQQRKIQLTPRGPLHEDTIYGKRLQYVTKEEKVGGSFDEAKIASVCKKSYREALMRRLMECGGDPKKAFTGKNSLEKNPVWVDEFHSGEVPLRVRTVSMASVYTVRKSVGQSLNIEKVLDKHIKEILRARLEEYGGNASKAFSNLDENPIWLNKEKGIAVKRVTIDSGKNPIPLRSKLDKDGQIIYGEGQNPQESDFVVPGGNHHAAIYRTPSGKLQDVVVSFYEAVSRKNLGLEVIDRNFKKDEGWEFLFTLKQNEYFVFPNPATGFSPEDYDLTDPANNAIISPNLYRVQTVSVGDYRFRHHLETTVEDNEKLRDIAWKRIGPSGLVGAVKVRIDNLGRILAVGEYD

SEQ ID NO: 1141 - protein, 1392 aa, Artificial Sequence
  Cas9
MENKNYSIGLDIGTNSVGWAVITDDYKVPSKKMKVFGNTDKHFIKKNLIGALLFDEGATAEDRRLKRTARRRYTRRKNRLRYLQEIFSEEISKLDSSFFHRLDDSFLVPKDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFSDEKSTSLFSEFLKLIVGNQADFKKHFDLEEKAPLQFSKDTYDEDLENLLGQIGDGFTDLFLVAKKLYDAILLSGILTVTDPSTKAPLSASMIERYESHQKDLAALKQFIKNNLPKRYNEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSIFDEKVIKALTRRHYTGWGKLSAKLINGICDKQTGDTILDYLIDDGKINRNFMQLINDDGLSFKEIIQKAQVVGKTDDVKQVVQELPGSPAIKKGILQSIKIVDELVKVMGYAPESIVIEMARENQTTARGKKNSQQRYKRIEDSLKNLAPGLDSNILKENPTDNIQLQNDRLFLYYLQNGKDMYTGKPLDIDQLSSYDIDHIIPQAFIKDDSIDNRVLTSSKDNRGKSDNVPSLEVVQKRKAFWQQLLDSKLISERKFNNLTKAERGGLDERDKVGFIRRQLVETRQITKHVAQILDASFNTEVNEKNQKIRTVKIITLKSNLVSNFRKEFELYKVREINDYHHAHDAYLNAVVAKAILKKYPKLEPEFVYGDYQKYDLKRYISRFKPSKEIEKATEKYFFYSNLLNFFKEEVHYADGIIVKRENIEYSKDTGEIAWNKEKDFATIKKVLSYPQVNIVKKTEIQTHGLDRGKPKGLFNSNPSPKPSEDSKENLVPIKQGLDPRKYGGYAGISNSYAVLVKAIVEKGAKKQQKTILEFQGISILDKINFENNKENYLLKKRYIEILSTITLPKYSLFEFPDGTRRRLASILSTNNKRGEIHKGNELVLPGKYTTLLYHAKNINKKLEPEHLEYVEKHRNDFAKLLECVLNFNDKYVGALKNGERIRQAFTDWETVDIEKLCFSFIGPENSKNAGLFELTSQGSASDFEFLGVKIPRYRDYAPSSLLKATLIHQSITGLYETRIDLSKLGED

SEQ ID NO: 1142 - protein, 1392 aa, Artificial Sequence
  Cas9
MNNNNYSIGLDIGTNSVGWAVITDDYKVPSKKMKVLGNTDKHFIKKNLIGALLFDEGATAEDRRFKRTARRRYTRRKNRLRYLQEIFSEEMSKVDSSFFHRLDDSFLVPEDKRGSKYPIFATLAEEKEYHKKFPTIYHLRKHLADSKEKTDLRLIYLALAHMIKYRGHFLYEESFDIKNNDIQKIFSEFISIYDNTFEGSSLSGQNAQVEAIFTDKISKSAKRERILKLFAYEKSTDLFSEFLKLIVGNQADFKKHFDLEEKAPLQFSKDTYDEDLENLLGQIGDDFADLFLVAKKLYDAILLSGILTVTDSSTKAPLSASMIERYENHQKDLAALKQFIQNNLQEKYDEVFSDQSKDGYARYINGKTTQEAFYKYIKNLLSKFEGSDYFLDKIEREDFLRKQRTFDNGSIPHQIHLQEMNAIIRRQGEHYPFLKEYKEKIETILTFRIPYYVGPLARGNRNFAWLTRNSDQAIRPWNFEEIVDQASSAEEFINKMTNYDLYLPEEKVLPKHSLLYETFAVYNELTKVKFISEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYASIFDKKVIKALTRRHYTGWGKLSAKLINGICDKKTGKTILDYLIDDGYSNRNFMQLINDDGLSFKDIIQKAQVVGKTNDVKQVVQELPGSPAIKKGILQSIKLVDELVKVMGHAPESIVIEIARENQTTARGKKNSQQRYKRIEDALKNLAPGLDSNILKEHPTDNIQLQNDRLFLYYLQNGKDMYTGEALDINQLSSYDIDHIVPQAFIKDDSLDNRVLTSSKDNRGKSDNVPSLEVVQKRKAFWQQLLDSKLISEHKFNNLTKAERGGLDERDKVGFIRRQLVETRQITKHVAQILDARFNTEVNEKDKKNRTVKIITLKSNLVSNFRKEFKLYKVREINDYHHAHDAYLNAVVAKAILKKYPKLEPGFVYGDYQKYDIKRYISRSKDPKEVEKATEKYFFYSNLLNFFKEEVHYADGTIVKRENIEYSKDTGEIAWNKEKDFATIKKVLSLPQVNIVKKTEIQTHGLDRGKPRGLFNSNPSPKPSEDRKENLVPIKQGLDPRKYGGYAGISNSYAVLVKAIIEKGAKKQQKTVLEFQGISILDKINFEKNKENYLLEKGYIKILSTITLPKYSLFEFPDGTRRRLASILSTNNKRGEIHKGNELVIPEKYTTLLYHAKNINKTLEPEHLEYVEKHRNDFAKLLEYVLNFNDKYVGALKNGERIRQAFIDWETVDIEKLCFSFIGPRNSKNAGLFELTSQGSASDFEFLGVKIPRYRDYTPSSLLNATLIHQSITGLYETRIDLSKLGED

SEQ ID NO: 1143 - protein, 1392 aa, Artificial Sequence
  Cas9
MKNYHIGLDIGTSSVGFAARDDENNLIRVKGKNVIGARLFAEGKTAQERRMARTSRRRYNRRKWRLRLLNDIFHDEIVHKDKDFFNRLKQSSISPKDDRKKYFGSLLFPELSDSEFYHNGNQTIYHLRHRLMTSNEKADIREIYLALRHIVKYRGNFLDDTPVSSFEASDLKLGSFIPTLNDLFETIDVNYVFNSENTNQIESILLNNDLRNSDKSKQLVDLLYRNVSDVDDKSLEKQFNKFRKDISKEIAKSFVGSKFNVNKLLAYETDDGSKISLSFSDASSDDKMLELADNLDDERINILNALKVIYSRVRLNQIIPNGMGLSESMIASYELHKKQLNDLKKLLNVLPFHEKYAVKVAYAAYIGNMDAQKFTQAELSTIESLKEKDSIKKVIDCKTGHITNESLISVINQIVVNPYLENSDFELIDIVKKIDQDIKNGEYLLKQRNNQNGNIPHQLHQMEMDQIIEKQSKYYPFLGELNPNENRRHIAKYKISELVAFRVPYYVGPLITPEEQAKTSGASFAWMKRKEDGEITPWNFDQKVDREATASRFIKRLTVKDTYLFNEDVLPDNSLLYQQFKVLNELNVVKVNNKRLSQAEKQGAFNDLFKVTKTVTAKRLKNYLVSNFNHLDTIEITGLSDGEKFNNGLTSYVDFQKIFGDKINNLELMDDFESLIEWSTVFEDRHIFEEKVRNEINWISESELKQLVAKRYSGWGRLSSKLLVGINNDEGRNIIEQLFETSETFMEAISRPEVKKQIDEINSDFIKNTDIESVLADAYTSPQNKKAIRETYKIVKDIQKAMGGKAPESISIEFTRNPEDKGELTRSRHSEISRKYKELSKEISKELNDELKSKKNSMDIDKYYLYFMQMGKDLYDGKSIDIDDLNNYQIDHIVPQSFYKDDSFDNRVLTYYTNNQKKGNNTPLNGLNISNETRKLWSHLHDLGLISKRKYLNLTMQGLDSLSKYTKHGFIRRQLVETSQVIKLVANILSDEFSADNTKIIEVKAKMNSQMRHSFNLYKIRELNDYHHALDAYLTTFIGGYLYNRYPKLRGMFVYGDFKKFDVNDANNVKTLNFLHDITNPSDKFVNQIYDEQSGELILDRKHAIETIKKIYQYKFMLITREVSTKDDKLSDQTVYSAKRINNVASPIPVKKDSNPELYGFRTGNVDHHMVIVKYPKKDSFVYKVVGIPIRFMQELRSSKNQSEYENTLNQIVQAKLNRKKFDFRVVVDNVMYGQLIQDGGQKFTLGSSTYRYNAKQLVLDMDSLRILSDEKYRNSLTDDEKNSEFINIYQQVLNVVNEKFDVFDVRGTRDKLTKGLDKFLNITSNDKEIVLLKILSGLHCNAARVKINEIGINTSFGELQTTHGIVLSENSYIIYQSPSGLFERKVRLKDL

SEQ ID NO: 1144 - protein, 1392 aa, Artificial Sequence
  Cas9
MANKTWYLGLDIGSASVGWAATDTGYKIIRKNKKRLWGVRLFEEAKTAEDRRGYRSSRRRLARRKWRLNLLEELFTSEVKKVDENFFLRLKESQYHYEDKTHKVPYAIFNDKDYTDKDYYKDYPTIYHLRSKLMTEENPDIRKVFLAIHHIIKNRGHFLLQGQSFKDGNLNNLIKELLELDILHVGFEVTEEVVDKIADISLEKKTSKDKLNDIKELYPKEKQLLEVFRLIFGGKTSLDKLFAIDEYKELDAAIKSVSFKEKIYEEVRHDYEQVLSNYIELLDLAKLVYDSIILSDIKKEGKTLSESKVELFEKHRDDLLKLKNLVKNDSKLSEDKKVELYALIFKEDKDKGTNYVNYIRKSEEGKGCNYEDFKKFLVKELAKLEESSVKTEIIKDLELEQFLPLQRTKDNSVVPYQIHKEELVKILDNAARYHSFLNEKDESGYNVREKVIQLLEFRIPYYVGPLNSSKKAKEGGFAWSVRNTGYENTPVTPWNYSKVIDESASAEKFITNLTNKCTYLKGEDVLPKSSLLYSEFALLNELNALKYDGNRISLEARNTIIEKLFKQQGKKVTKTSIKNLLKAEGYIDGKGEITGIDITVKNDLKSYRDFKKILGNKFNSEHVENIILWITLYGESRKLIKAKIESVYGEVYSKDEITKMSRLVYKDWGRFSRKLLTELVSKKLYNEETGECLNIIGAMRQNNILFMELLADRFDYSKQIVEFNKELQEDVTEIAPEILDDLYVSPAVKRSIWQTVRIVEELKKIIGCAPAKIFVETTRSNQEKKKPTDSRKKQLELAYKAVKKDVKELEKEIGTINFDVLNDRLSSVEPSKLKAKKLYLYYTQLGRCMYSEEPINISELFDNNKYDIDHIYPQSKIKDDSFTNTVLVKRESNAAKTDRYPLGSDIQTPSNRRFWKFLKEKGLISDEKYNRLVRTEEFSDEELSGFIARQLVETSQSVKAVASILGELNPETSICYSKAENVSSFRQNFGKIKKGDRDSKNNDQLIKVREINDYHHAKDAYLNVVVGNVYDTKFTRNVFNFIKDKKDGRKYSLNKVFYENVSDSKTVAWEMDKTIHQVEKVMNNNNIMVTRRTSEQKGGLFDATVYKAKVAAKAKDGVYYPLKTSNSVVKDVAKYGGYTSIGIAYYSIFEYTIVNKKGEEKITRIIPIPIYISQNIKDSTALIEFGKSQIFCRAYEKIKDFKLLYRKLCIGSKININNYQYYIGGKSDERFYYDSAIQVTLDKKSEKYLKILSKYQNWKKENKDGELWENITKENNIELYNKLVEKMNSEIFTKKKSNKYNELNSEEIRNNFIKISVEEQAKVLLEILNLLTNKKSIFDLKSIDIKAARGKISFNLTSLIQFSIIEQSITGFYEKEITIIGDKGNDMENNNS

SEQ ID NO: 1145 - protein, 1392 aa, Artificial Sequence
  Cas9
MNNNNYSIGLDIGTNSVGWAVITDDYKVPSKKMKVLGNTDKHFIKKNLIGALLFDEGTTAEDRRLKRTARRRYTRRKNRLRYLQEIFSPEISKVDSSFFHRLDDSFLVPEDKRGSKYPIFATLAEEKEYHKNFPTIYHLRKQLADSKEKADLRLIYLALAHMIKYRGHFLYEESFDIKNNDIQKIFNEFISIYDNTFEGSSLSGQNAQVEAIFTDKISKSAKRERVLKLFPDEKSTGLFSEFLKLIVGNQAEFKKHFDLEEKAPLQFSKDTYDDDLENLLGQIGDGFAELFVAAKKLYDAILLSGILTVTDPSTKAPLSASMIERYENHQKDLAALKQFIQNNLQEKYDEVFSDQSKDGYAGYINGKTTQEAFYKYIKNLLSKFEGSDYFLDKIEREDFLKKQRTFDNGSIPHQIHLQEMNAIIRRQGEHYPFLQENKEKIKKILTFRIPYYVGPLARGNGDFAWLTRNSDQAIRPWNFEEIVDQASSAEDFINKMTNYDLYLPEEKVLPKHSLLYETFAVYNELTKVKFIAEGLRDYQFLDSGQKKQIVNQLFKEKRKVTEKDITQYLHNVDGYDGIELKGIEKQFNASLSTYHDLLKIIKDKAFMDDAENEATLENIIHTLTIFEDREMIKQRLAQYDSLFDEKVIKALIRRHYTGWGKLSAKLINGICDKKTGKTILDYLIDDGYSNRNFMQLINDDGLSFKDIIQKAQVVGRTNDVKQIVHELPGSPAIKKGILQSIKIVDELVKIMGHTPESIVIEMARENQTTARGKKNSQQRYKRIEDALKNLAPGLDSNILKEYPTDNIQLQNDRLFLYYLQNGKDMYTGEPLDINQLSSYDIDHIVPQAFIKDDSLDNRVLTSSKDNRGKSDNVPSLEVVQKRKAFWQQLLDSKLISERKFNNLTKAERGGLDERDKVGFIRRQLVETRQITKHVAQILDARFNTEVTEKDKKNRNVKIITLKSNLVSNFRKEFKLYKVREINDYHHAHDAYLNAVVAKAILKKYPKLEPEFVYGDYQKYDLKRYISRSKDPKDVEKATEKYFFYSNLLNFFKEEVHYADGTIVKRENIEYSKDTGEIAWNKEKDFATIKKVLSLPQVNIVKKTEIQTHGLDRGKPRGLFNSNPSPKPSEDSKENLVPIKQGLDPRKYGGYAGISNSYAVLVKAIIEKGAKKQQKTVLEFQGISILDKINFEKNKENYLLEKGYIKILSTITLPKYSLFEFPDGTRRRLASILSTNNKRGEIHKGNELVISEKYTTLLYHAKNINKTLEPEHLEYVEKHRNDFAKLLESVLDFNDKYVGALKNGERIRQAFIDWETVDIEKLCFSFIGPRNSKNAGLFELTSQGSASDFEFLGVKIPRYRDYTPSSLLNATLIHQSITGLYETRIDLSKLGED

SEQ ID NO: 1146 - protein, 1392 aa, Artificial Sequence
  Cas9
MNNNNYSIGLDIGTNSVGWAVITDDYKVPSKKMKVLGNTDKHFIKKNLIGALLFDEGATAEDRRFKRTARRRYTRRKNRLRYLQEIFSEEMSKVDSSFFHRLDDSFLVPEDKRGSKYPIFATLAEEKEYHKKFPTIYHLRKHLADSKEKTDLRLIYLALAHMIKYRGHFLYEESFDIKNNDIQKIFSEFISIYDNTFEGSSLSGQNAQVEAIFTDKISKSAKRERILKLFAYEKSTDLFSEFLKLIVGNQADFKKHFDLEEKAPLQFSKDTYDEDLENLLGQIGDDFADLFLVAKKLYDAILLSGILTVTDSSTKAPLSASMIERYENHQKDLAALKQFIQNNLQEKYDEVFSDQSKDGYARYINGKTTQEAFYKYIKNLLSKFEGSDYFLDKIEREDFLRKQRTFDNGSIPHQIHLQEMNAIIRRQGEHYPFLKEYKEKIETILTFRIPYYVGPLARGNRNFAWLTRNSDQAIRPWNFEEIVDQASSAEEFINKMTNYDLYLPEEKVLPKHSLLYETFAVYNELTKVKFISEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYASIFDKKVIKALTRRHYTGWGKLSAKLINGICDKKTGKTILDYLIDDGYSNRNFMQLINDDGLSFKDIIQKAQVVGKTNDVKQVVQELPGSPAIKKGILQSIKLVDELVKVMGHAPESIVIEIARENQTTARGKKNSQQRYKRIEDALKNLAPGLDSNILKEHPTDNIQLQNDRLFLYYLQNGKDMYTGEALDINQLSSYDIDHIVPQAFIKDDSLDNRVLTSSKDNRGKSDNVPSLEVVQKRKAFWQQLLDSKLISEHKFNNLTKAERGGLDERDKVGFIRRQLVETRQITKHVAQILDARFNTEVNEKDKKNRTVKIITLKSNLVSNFRKEFKLYKVREINDYHHAHDAYLNAVVAKAILKKYPKLEPEFVYGDYQKYDIKRYISRSKDPKEVEKATEKYFFYSNLLNFFKEEVHYADGTIVKRENIEYSKDTGEIAWNKEKDFATIKKVLSLPQVNIVKKTEIQTHGLDRGKPRGLFNSNPSPKPSEDRKENLVPIKQGLDPRKYGGYAGISNSYAVLVKAIIEKGAKKQQKTVLEFQGISILDKINFEKNKENYLLEKGYIKILSTITLPKYSLFEFPDGTRRRLASILSTNNKRGEIHKGNELVIPEKYTTLLYHAKNINKTLEPEHLEYVEKHRNDFAKLLEYVLNFNDKYVGALKNGERIRQAFIDWETVDIEKLCFSFIGPRNSKNAGLFELTSQGSASDFEFLGVKIPRYRDYTPSSLLNATLIHQSITGLYETRIDLSKLGED

SEQ ID NO: 1147 - protein, 1393 aa, Artificial Sequence
  Cas9
MKRVTEDYILGLDIGTNSCGWAVTDKKNNLLKLRGKTAIGSHLFEEGHTAADRRGFRTTRRRLKRRKWRLRLLEEIFAEPMAKVDPGFFVRLHQSWVSPLDKSRKKYHAIVFPTAKEDKAFYQKYPTIYHLRDALMTQDRQFDLREIFLAIHHIVKFRGNFLQDTPVKDFEASKIEVGPILSKINGAFAEKIVEDQDPIELNVANAAEIEAVIRGKDADKTLYKMDKVKKIAKLLTDSTAKEEKNVAKQIANAVMGYKTQFETILGKEIDKSDKAQWEFKLTDGDADDKLEALLPDLDENDQTIIAEIKKLFSAITLSTIVDENKSLSQSMVAKYNKHHQDYKLLKAYIDTLQDRSIAKKLLLAYDLYVNNRHGRLLEAKTEFKQDGTLTKEDFYKTVKDNLDDSELARKIAQKIAADNFMPKQRTNSNGVIPFQLHQIELDKIIANQSKYYPFLAAENPVEDHRKQAPYKLDELVRFRVPYYVGPMITPDEQEKTSGKSFAWMVRKEDGQITPWNFEQKVDRQESANKFIKRMTIKDTYLLGEDVLPANSLLYQRFEVLNELNNIRINGSRISIDLKQQIFNDLFEEKKTVTEKSLTSYLKQNLHLPTVEIKGLADPTKFNSSLASYYHLKSLHVFDKELADPQYQKDFEKIIEYSSIFEDKKIYQDKLHAEFKWLTPEQFKAISTWRLQGWGRLSCRLLVELHDTNGQNIMEQLWDSQKNFMQIVTEPDFKDAIAKENQNVTQVNGVEEILADAYTSPANKKAIRQVVKVVADVVKAAGGKKPAQFAIEFTRDPDKNPQLSHIRGTKLLKAYQETAGELVDQKLTDSLKEAMTSRKLLKDKYFLYFMQTGRDAYTGKKINIDEVTTNYQIDHILPQSFIKDDSFDNRVLTATPLNAEKSDDVPYKRFANNYVSDLKMTVGEMWKHWQKAGIINKHKLGNLLLDPDRLNKFQKSGFINRQLVETSQIVKLVSVILQNKYPDAEIITVKAGDNSALRQRLNLYKSRDVNDYHHAIDAYLSIICGNFLYQVYPKYRPYFVYGKYKKFSQDPDLQKDLIKHFKGFTFMWPLLQKDNSERKAPEEIKENNSERIVFYKHPDIFDKLRKAYNYKYMLVSRETTTESSSMFKMTIFPRGERDRKKTRKLIPKGNGLDPKIYGGYSGNTDAYMVIVKIDKAKESIYKVIGVPMRALTRLNQAKKQGNYQEELHQVLEPQIMLDKNGKPKRGVKGFRVIKDHVPFKQVVLDGDKKFMLYSAQYKTNAKQLALSQETMRIVTDNLKKGEDQDKLLVKAYDEILQKVDCYLSLFDTSNFRNGLHLGRNKFIDLEVNDKKITLSNILNGLHDNMVLGNLKNIGIGTPLGQMQEKSGITLSPEAVLIFQSPTGLFEKRVKIADL

SEQ ID NO: 1148 - protein, 1395 aa, Artificial Sequence
  Cas9
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSELQHIGGSKYSGVAKIGNKISSLDNCILIYQSITGIFEKRIDLLKV

SEQ ID NO: 1149 - protein, 1395 aa, Artificial Sequence
  Cas9
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGAFSNISKYGGYNKVSAAYYTLIEYEEKGNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNPDNCILIYQSITGIFEKRIDLLKV

SEQ ID NO: 1150 - protein, 1395 aa, Artificial Sequence
  Cas9
MGDTVKNYHIGLDIGTSSVGFAARDDDNNLIRVKGKNVIGTRLFSEGQTAQERRMARASRRRYNRRKWRLRLLDEIFHDEIIHKDAEFFNRLKQSSLSPKDERKQYFGSLLFPEVGDSEYYHDGNQTIYHLRHRLMTQDEKADIREIYLALRHIIKYRGNFLDDTPVSSFEASDLKLASFVPTLNDLFETIDVNYEFSMDNINEIEDILLNNKLRNSDKSKQLPDLLTEPIVNIDDKSLEKQFNKERTDISKEIAKSVVGSKMNVNKLLSFESSGGYKIAFSFSDASSEDKMMELSDVLDDSRMNILNILKVIYSRVRLNQIIPSGMGLSESMVAAYDLHKQQLKDLKKLLNVLPFNERYAVKIAYAAYIGNIDKQKFTKSEVKTIDKLKEKSAIMNVLDFKSGHITNEELSNVIKVVIVDKYLNDENFEYHSIVEKINQDISNGSYLLKQRNNQNGNIPHQLHQMELDQIIENQSKYYPFLGELNPNSNRNHIAKYKISELVAFRVPYYVGPLITPEEQEKTSGASFAWMKRKEDGAITPWNFEEKVDKEETASRFIKRLTVKDTYLLNEDVLPDNSLLYEKFKVLNELNVVKANNKRLTVEEKQGAFDNLFKKMKTVTAKKLKNYLVSNHNHINSVEITGLSDVDKFNNSLSTYIDFKKIFDDKIDNPDLLDDFEDIIEWSTVFEDRKIFEEKVRKDISWISESEIKAVVSKRYSGWGRLSKKLLNGITNNEGRNIIDELWEESETFMEAVSKPEVKEQIDGINSDFIKNTDIESVLADAYTSPQNKKAIRETHKLVKDIQKAMGGQAPASISIEFTRNPQDKGQLTRSRHSEVSRKYKEISKEVSKTLNDELKSKKNSMDVDKYYLYFMQMGIDLYDGSSIDIDDLNNYQIDHIIPQSFYKDDSFDNRVLTHYSNNQKKGNNTPLNGLNIDDKTRAIWNHLRDLGLITKKKYNGLTLKGMDQLSKYTKHGFIRRQLVETSQVIKLVANILSDEFSTDDTKIIEVKAKMNSQIRQVFNLYKVRELNDYHHAVDAYLTTFIGGYLYNRYPNLRNMFVYGDFKKFSADVDNLKTFNFLHDITNPSDKFEDRIFDEKSGELILDRKHAIETIKKIYQYKYMLITREVSTKNGQLSDQTVYSAKRINNVKAPIPVKKDSNPELYGFRTGNVDHHMVIVKYPKKDSYDYKVVGIPLRFVQKLKETKDNKDYENLLNQIVQMKLNRKKQDFIVVVDNVMYGQLIQDGGEKYTLGSSTYKYNAKQLVINMDKTRILEDNRYLNSLDEGEVSEKLVNIYNDIMKVVNSRFDLFDINKFREKLNDGLNKFKNISNEQKEETLLKILSGLHCGSANVPIKELGLTTPLGKLQLPSGIVLSEEAVVIYQSPSGLFENKVRLKDL

SEQ ID NO: 1151 - protein, 1395 aa, Artificial Sequence
  Cas9
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 1152 - protein, 1395 aa, Artificial Sequence
  Cas9
MNANREMAYYIGIDMGTGSVGMAITDENYNLLKVKGQDYWFVREFETANTQIKRRMHRISKRRLRRHQVRVALIRSYFAEEILKNDPLFFIRQDNSIYYLEDKDSVLKTKDCLFADYNYHDKNYYKDYPTIFHLRQAFIKDTVKDDENHTRYARLLYLAIINMFEHRGHFLLNSVSEDINKEMVKDAGEGFTLYLQERIKEIKPVSYSDILDVLVEKNISRSEKKERIVELFGIKKSCKNGMEIIKCLCGLEANVAIMFNLDDIENKLTIVVSKDDYEDKLAEVQPLVDEESFELLSRIKQLYDYSQLQSILKGYKEKEDGEDKYLSDVRVELYEKHKADLKLLKKVYKRDLDKKGKICEGKNIQRSSKYNFMFRSGKDGTYSAYTNSLNSFCSKTIENKYRRNMKNRDRASLYDTIKKDLSGIENDDVKKILRDIETEKFLPKQITGENGVIPNQIHAKELKAILKNAEKHLPFLTEKDDSGLTVSERIISLFRYCIPYYIGPVGKDSRTGWASIKEEGQIFPWNIEQKIDVDKTSEEFITRLIKTCTYLSNEKVVPKQSLVYERYCVLNEINNIKIRGKRIDPQLKQEIFKELYIGSKCGKKVTRKNLCQYLVNKGAIEEDSEISGIDKDLNTYMSSYGKMYQIFGDKIKRDDIKEVAEEIIYYGTIYGGAKEMFKKKIEQYVSEDILDEAQMNRILGFKFKDWARLSKKFLYLEGYDKGNQNQLTTLMQALWDYNLNTMELMNSPMFTFKETLEKQKNKMEKVLCDFEYEDLDEYYFSAPVKRMVWQTIACLKEVVQIMGHNPKRIFIEMPRADEEKGEQGRKASRKNRLLSLYEEIEDERPWKKEIENAAESGRLNSKRMYLYYLQMGKDAYTGEDIDIEDLFDNSKYDIDHIYPRSLTDDNSLENNLVLVSATINQDVKKNDYPIPYDKIRGNSKVRELWRFLHEKKFMNDEKYNRLMSDVPLTQEQLAGYIARQLVETAQGTKGIADIIKSVIPDADIIYSKAKNVSDFRKRYGMLKSRLTNDFHHAKDAYLNVVVGNVYFTKFTQNPRKYIKDENDIENKKYNYNLSKMYDKDVIRNGKVAWIAQNGKKAGTIQTIKKVMDRNTPIITRQAFEQRGELYDLQPISKHKAKKENYVPIKATNEKMKDVTKYGGFTSLNPAYFVFVEYGSAKKRQRCFAVVHSYWASSIKNNEDLVTHLKDRGYENPIVIADKIKKNSLIKYNGYFLYIVGMDARKQVEFSNATSMCLNNNFIQYIQKIEKANTLIAEAKKRRPYIDESITAERNIALYNELKKKHLDSIFKNHPKGIGSVLESGEGAFVQLSLEQQIGILYSIIQFSSFKKGTFSLTLIGGPKEVGRIRISGNMPKARELKLIHYSITGMYKKEINLLD

SEQ ID NO: 1153 - protein, 1395 aa, Artificial Sequence
  Cas9
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYTDQDYYKEYPTIYHLRVALMKSGTDDIRKLFLAVHHILKYRGNFLYEGATFDSNASTLDDVLKQALENITFNCFDSSAAIGSIGQILMELGKTKSDKAKAIERLVDTYIITDEVDTSGKTQKEQVKEDKKRLKSFANLVLGLSASLTDLFGSVEDLDEDLKKLQIIGDTYDERRDDLAKVWGDEIHIIDDCKSVYDAIILMSIKEPGLTISESKVKAFKKHKDDLAILKSLLKSDRSIYNTMFKVDEKGLHNYVHYIKQGRTEETSCNREDFYKYTKKVVEGLPDSKDKEYILSEIELQTLLPLQRIKDNGVIPYQLHLEELKVILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKAVKEHLIEAVFKQDHKKMTKNRIEQFLKDNNYIPEKHKPEITGLDGEIKNDLASYRDMVRILGNNFDLSMAEEIITDITIFGESKKMLRETLRNKFSSRLDDEAIKKLSKLRYRDWGRLSRKLLNVIEGCDKAGDGTPETIIILMRNFSYNLMELLGDKFSFMERIQEINAKLIEGQIVNPHDIIDDLALSPAVKRAVWQALRIVDEIVHIKKTLPARIFVEVTRSNKAEKKKKDSRQKRLSDLYAAIKKDDALLSGLTNEEFGGLKSGLAKYDDAALRSKKLYLYYTQMGRCAYTGEVIDLSQLNTDNYDIDHIYPRSLTKDDSFDNLVLCKRTANAQKSDTYPISKEIQKAQKAFWIFLKQQGLISERKYERLTRITPLTADDLSGFIARQLVETNQSVKAATTLLRRLYPGVDVVFVKAENVTDFRHDNDFIKVRSLNHHHHAKDAYLNIVVGNVYHERFTRNFRAFFKKNGANRTYNLAKMFNYDVKCTNAKDGKAWAVKTSMDTVKKMMDSNDVRVTKRVYEQKGQLSDINLTKASKVKADIYLPIKANDPIMSQNMKYGGYSDIKNAYYTIIEYSDKKNNSIKAFIPIPIFIATKTLTKQALLEYIKTVLPKANNLRIIYKKVYNDQLLKIDGFNYYLGGRSNDRFCIDNAIQLIVPLEIQFYIKLVEKFTAIISENKNIALKASSVKSRNPINNQVENITLEYTQKLFDYLVSKFNELIYLKMRGNKLTDVNNIGRKQFIKLSLEERCKALAELLNIFTNMNKKLSLSTINVSASRKVVNFKISSLDEFKIVNESITGLYSHEITIV

SEQ ID NO: 1154 - protein, 1395 aa, Artificial Sequence
  Cas9
MNLRNTTDEYNIGLDMGTNSVGWAVTDKVGAIAHFKGMPTLGSRLFDAAQTAAEARAHRGQRRRYVRRRWRLDLLQSLFQDEIDKVDSEFFIRLRQSRLHVEDREDGHADYKWPIFNDSDFTEVDYYKRFPTIYHLRKWLIETDQKADIRLIYLAVHNIVKHRGNFLRENNKNLSSRNADPAEAVGHLRLALNNWCLERGYECAWKSGGNDNAILNVLIDGEKRRSDQVREIAKLTGIDCGDAKQSRQCNEAIAKAIVGLKAEMKNIFGEFPAEKTLIYLSSDDDVEVVRDACPDDSVELFQALCELYAAYILQGLLSYAPGQTISVNMVKKYDRYGEDLHLLKELTRTYASKRYDAFFRGETYEGSSDYVVDKAQGYTRYNLGTTQLSYDDFQKAVKELFKGTDALQDERYQGMMVAFGEQRFLRRLKTSDNGSIYYQLHLEELHAILENQGKHYPFLLAEEDKIESLVSFRIPYYVGPLTRENAAVGHDGKERFAWSSRRDGMEHAVITPWNWEEIIDRDKSAEDFIIRMTGDCTYLQGEPVLPKCSLLYEEFCALNELNGAHWTIDEDDERRFDAAQRERIMCDLFRSTRKVTYKKVSDWLEREDSFVGARVHGGQGEHGFESQLGSYIFFCKDVFKTDSLDEADYPMIEQIILWSTLFEDRDILRRKIEEAYGDRLTTEQIKVICKKRFAGWGRLSKKLLTGIKVDTDTGRKSIIDVLREGNPNDGQRSRTMVFMEVLRDEGLGFQKAVDDFNRDYFSEHNNGLMDVNDLPGSPAIRRSINQAVRIVDEIVSIAKKEPANIFIEVTREEDDPRKKGKRTKRRYDAIKSALEVFKKDDPQLWKELTKKDSNNMDERLSLYFMQRGKCMYSGRPIKIEELHTGKYEVDHIIPRSYIKDDSLENKVLVYREENQHKTDTLLIDSSIRRKMGKYWRMLHNAKLIGDKKFRNLFRDHIDDKTMKGFVARQIVETSQMVKLVQTLLEARYPGARIVPVKANISHDLRDAAGLVKCREANDFHHAHDAFLACRVGLFIQKRHPSVYDNPIGLAHIMRDYARAQAREYKKSHYLAHTKGFIVNSFLSSGFDKETGEVFKDDWDAEAEVEGIRRVLNYRQCFISRMPVEATGTFWDQTIYSPKCGKKLTLPLKRGLDPDRYGSYSREQFAYFFIYEARDLKHERHILQFAQVPVRVAAHIAKDPSQLESYAVKLAGQANLAFVRIVRRRILKKQLLELNGDRLIITGVREVRNATEFAFSLDEETLIERCVQIAKVGSLIGVVNDEDEEQLSADLNELFSSLVKRGPKLCNRLYAQLKLDKYLSKFDELTLTDKAKVVLQLIAITNGSINMADLSALGSSKYAGCMQVSYFKQLNAPIGEVNIIDQSVTGMFERRTHIGL

SEQ ID NO: 1155 - protein, 1395 aa, Artificial Sequence
  Cas9
MKEIKDYIIGLDIGTNSCGYVVTDKQNNILKLKGKTAIGARLFKEGQAAADRRSFRTTRRRLARRHWRLGLLEEIFDPEMEKIDPNFFRRLKESDYSPKDSRKQFNAIVFKSIKADKRFYKKYPTIYHLRNALMHDNQKHDLREIFMAVHHIVKYRGNFLREDSVNAFKAAKFSLRGEDGIGPVDKLNDLLKEIYSEYSPELATNNLSKIEDIIKDKNLYKQDKLKQVATLLIKEADSKDKAKLNKDIAKQVANSFMGYMFRLDTLFSLTDVDVKDYKLKFSDANIDESLDDLTSLLTDAQIEFVLELQSIYNTIVLNEIVPDGMSLSESMIKKYDDHKEDLKIFKEYIDSLSDQKKAKKLLSAYNLYVNYRKSDLVEAKNLFKNKKVGDKNFADVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNLEEMVDTTESANQFIKRMTRKDTYLLAEDVLPKSSLVYQKFMILDELNRIKIDGKKLTSELKHDIFEKLFKKQKSINLDNLKNYLLVEGNIPGLIEGLSDGINFNNSFSTYIDYRNIFGDEIDNPNKQADFEKMIEWSTVFEDRKIFKRKLKEITWLTSEQIKQVSSKRYSGWGRLSKKLLTQITDENGVNILQRLWNEPETLTEVLANPVIKRKIVEANSSFTKAKDMKDILVEAYTSPQNKKAIRQVMRVVDDIIAAAHGKKPSQIAIEFAREDQDNPQMTKSRKAQLDQIYAKISDEFLDDAVKNELKNMKDNKPLAKDKVFLYFKQMGRDAYSGEKLSLDNLQDYDIDHIYPQSFIKDDSFDNRVLVQRAYNNGKSDNVPVLLFGNKIAAGLGITIRQMWKKWLELGLISKRKFNNLITDPEKISRNMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAENQEDDPVKKIKKFNFIYQLIWGKDDAICISHTNQQVFSKKDIIDKLTTAYNFKYMNISHAVYTRNNNMFKQTLFPIIERTTAKTKSLIPKKLDRPTDIYGGYSNNNDAYLALVKVDKKRGSEYRVVGIPMRAAAMLKASKNYDEDLRKVIEPMVMFDKNGKAKRGIEGFRVLVGKMPFKQAVLDGNKKFMLTGTVDTPNLKQLVLSQQNMKYILDYIEDVDCRKHKFGDKVQNPDKCLLEVFDEIIEIVDKYFELFDSRDFREKLRNSRNKFIKLEASKKADTILAILKGLQAKSTRATIKELNISDFGRIITSSISPEAQLIYQSPTGLFERRVKVKDL

SEQ ID NO: 1156 - protein, 1395 aa, Artificial Sequence
  Cas9
MSKKYQNTKYYVGLDIGTSSVGWAVTDANYELLKVNGHKTWGSRLFTEAETALERRTHRATRRRLQRRKQRLDLLDELFAEELAKVDPQFLLRLKESQYHMEDKSTDDKYVLFNDQNRTDGEFFTEYPTIYHLRSELMQGKKEDIRAVYLALHHIVKYRGHFLLPGDNYDMQGNLSELIKRLFKFIEETLFIEDLGLTDEIQSKIEEILLTKTKTRLDRQKEIVKLFNTKHQKLDDKQKKLLEAIFKLCLGLKGNMVNIFGDKGEYGIDFTDVEDKKKKVEFSADYDNNINDYVDFFGEYFELLEITKKINDTVIFSEILVDGKGFSESKVISYEKHQQDLRKLKTLLKSLDKTLGYKYGEGLYQKILLDDVKSNYVNYSGNSQKLKKCTKDEFYGFIKSKLNSVTKKEKVSEAQQKEIAQILADMEFGDYLPLQRTTDNGVIPNQLHKKELIEIIEQQTKYHDFFNDVDENGLTIKDKIISLMTFRIPYYVGPLNDYHKVADGTGHAWIEKKKDGKIYPWNFDEMVDTEATAEKFIKNLTNKCTYLKGEDVLPKESKLYSEFMLLNELNNIKIDNQKLDPKLKMKMVSELFMKKNEKITKKKIVDYLRSIGQANGNEMVSGIDREIKSDLKTIHKIQHYYQDASLEMAENIIRWNTIFNDSTSDILKDKITKAYGDVLTPGQIKGLSNLACKDWGKLSEKFLTGIRCDVGEFKNISIIQAMRDTNNNLMELLSNKYEFMDKIQEYNKEYYGDFTFKAEPSIMDDLYVGPGPKRAIWQAVRIVEEIKRIMGHDPEKIFLETTRTNRAPKVKNTKRYDALEKKYESVKEHEYAEVKKEFEIEKNDSLNIKKLFLYFTQLGHCMYSDEKIPYNELFTNRYDIDHIYPRSKTRDNSMDNLVLVKAECNRDKKDNYPIKLKTNIQQKCQVRWAYLRDKKLITEEKYNRLVRKTPLTEDELSQFIARQLVFTSQSVKATAEVFKRLYEDSKICYVKAENVSDFRYGSTRKMSKDDQPQPFIKNRDVNDFHHAKDAYLNIVVGNVYDVKFTQNPTRFIKANKDYSLNYIFRYPVNKKGENVWDPEQSMKIVEKTLKSNDVRVTKLVKPITSPISNETLHKALKCKPGSYLPRKSSKGTPLADVTKYGGYEKIKNAYYSIYKYTYMKKKECMEEFLLVPIPIHLVNNDEELPKYINDKIAERAKKKKLETVECIVKELYQGTLVRINGYDYRIAGSSGKQFELHNGINLIVEPWVEKVLKETDKFVRKSNSKLDKKQQKENTTETLIEKQLNDVFEYLCRKLNQGIFKNNKHTLPAKLLGDSIQKRFEDASIEDEFEVIKELISAIAKNPQNFKTIQKVLDISGSSIPRFNLKLTKNNVDEFIIKNESVTGLFTHEKVIFRK

SEQ ID NO: 1157 - protein, 1395 aa, Artificial Sequence
  Cas9
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMELDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSAYVGVCKITHKKLVIKNSASQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 1158 - protein, 1395 aa, Artificial Sequence
  Cas9
MSFKKILGLDVGVASIGWAVVRENEENPNFNTITKLGVRVVPITSDEKLNFEKGKSITSNAERTLARSSRRNLQRFRLRRKNLIAILLQNQIITPTTPLTEKGKFTTFETLKIRAKATKEKIELEELARVLLHINKKRGYKSSRKVKNSEDGKAIDGMEAAKILYENKLTPGQYTYQLLEKGSNKIPDFYCSDLQIEWEVIWNFQKQFYPNLLTEDFKKELKGIGQRATAALFLKKYGIYTALNKGKREEKKLQAYKWRSKSVSEKIPVEELAYVIAEINSHITNSSGYLGTISDRSKELYFNQQTIGENLYAQVAKNTHAKLKNQVFLRQDYSAEFEQIWETQAKFHPQLTPELKKKIRDSIIFYQRKLRSQKRLISICEFENREIEIIKNGKKKKKKIGLKAAPKSSPLFQEFKIWQVLNNIVIKQEGKDRLLTWEEKELLFTELNIKGNISGQKALALLKLSPKDTKINVTILEGNHTQEQLYRVYLRILGMEGYDVFDLLKIPENQDEIKPADSKISAAEIKETVKSVFKTCSISPSILDFDPLLPNPEFENQSSYQLWHLLYSYEGDSSPSGNEKLLELLKNKFGFKKEHALLLASISYTYIYGNLSSKAMRKIYPYSKENTYSEACMLAGYRHSKNALPREELVKYQLKDRLEILPKNSLRNPVVEKVLNQLINLVNSLMDEYGAFDEIRLEMARELKKNAKEREKWSKNIADATSRNQKHAEILKKDFKISNPSKNDLIRYRLYLELKANGYNDLYTNTYIDINYLFTHRYDIDHIIPQSKVLDDSFSNKVLVPRQANLEKSNLTAFDYISHQGKEKEEHYLNVITELYKRGSISETKYKNLQKKGNEIGEGFINRDLKNTQYIVRKAREILSLITPNVVTTTGEITAKLRKDWNLINSMKELNMDKFRNARLTELVENSRGEKKEIIIDWNKRNDQRHHAIDALVVAFTTRNHVQYLNYMNAREDESHKQHSHILSIEKKIKYDKFHENGSRQSRFIYPTSNFREEAKKKLKEILVSYKTKNKVVTVNINKPKKKGGYSPKHELTPRGPLHKETIYGMIRILHTKEIKVSSKLNFETVVRIQNPRYRNALLERLKDNFNDPKKAFSGTNSLTKNPVFLTANSTETVPEKVTIQWFEKVYTIRKPINPTNFKNEKNIEKVLDPTIRTLLKKRLQEYNGNAKEAFSDLEKNPIWLNQEKGICIKTVTITGISNVESLHTKKDHFGKELLDINGNPIPVDFVSTGNNHHVAIYEDSEGNLQEKVVSFYEAVERVNQGLPVIDTLYNLDLGWKFLFTMKQNEMFLFPADDFDPNDIDIYDEKNLILISKHLFRVQKLSSKDYCFRHHLETSINFNDPALKGITWRRESPNGLRNLVKVRLNHLGKIVHIGE

SEQ ID NO: 1159 - protein, 1395 aa, Artificial Sequence
  Cas9
MKKEIKDYFLGLDVGTGSVGWAVTDTDYKLLKANHKDLWGMRCFETAETAEKRRLFRGARRRIERRRKRIKLLQELFSQEIAKIDEDFFQRMEESPFYAEDKTILQENTLFNDRDFTDKTYHKAYPTINHLIKAWIENKVKPDPRLLYLACHNIIKKRGHFLFEGDFDSENQFDTSVQALFEYLREDMELDIDADSKKIKEILKDSALKNSDKQNRLNKLLGLKSSDKQKKALTNLISGNKANFADLYDNPDLKDAEKNSISFSKDDFDALSDELASVLGDSFELLLRAKAVYNCSVLSKVIGDEQYLSFAKVKIYEKHKNDLTKLKEVVKKYFPIEYRNIFGYKQSENNNCNYSRYVGVCKSGSKKKVINKTASQEDFYKFLKDILLKRSDVPEANGILTEIETGTFLPKQISKNNAEIPYQLRKIELEKILTNAEKFFSFLKQKDENGLSHSEKIIMLLTFKIPYYIGPINTSHKQYFPDRSWVIKKENAPQEKITPWNFFDHIDKEKTAEAFITSRTNFCTYLIGESVLPKNSLLYSEYTVLNEINNLQIIIDGKNICDVKLKQKIYEELFKKYKKVTQKQISTFIKHEGICNKTDEVIILGIDKECTSSLKSYIELKNIFGKQVDEISTKNMLEDIIRWATIYDEGEGKTILKTKIKAEYEKYYSDEQIKKILNLKLSGWGRLSRKFLESITSEIPGFIEPVNIITAMRETQNNLMELLSSKFKFNENIKKINSGFEDTDKRFSYNSLVKPLFLSPSVKKMLWQTLKLVKEISHITQAPPKKIFIEMAKGAELEPARTKTRLKILQDLYNSCKNDADAFSSEIQYLLGKIENEDNLRLRSDKLYLYYTQLGKCMYCGKPIEIGHVFDTSKYDIDHIYPQSKIKDDSINNRVLVCSSCNKNKEDKYPLKPEIQLKQKKFWNFLQRNNFISIEKFNRLTRTTPISDDETAKFIARQLVETRQATKVAAKVLEKIFPETNIVYSKAETVSMFRNKFDIIKCREINDFHHAHDAYLNIVVGNVYNTKFTNNPWNFIKEKRDNPKIGDTYNYYKVFDYDVKRNNITAWEKEKTIITVKTMLKRNTPIYTRQAACKKGELFNQTIMKKGLGQHPLKKECPFSNISKYGGYNKVSAAYYTFIEYEEKGNKIRSLETIPLYLEKDIQKSQDGLKGYLTDQLGKKEIKILVPKIKINSLLKINGFPCHITGKTGASFVLRPAVQFCCSNDEVLYFKKIIRFNEIRSQREKMGKTISPYEDLSFRSYIKENLCKKTKNDEIGEKEFYGFLQKKNLEIYDMLLIKHKDTIYSKRPNSTTLDMLIKGRYEFINLKPEDQIRVMLEILKLFCTTREVIDLGLIKGKSEAGVTTLGKKISNLDSCILIYQSITGIFEKRIDLLKI

SEQ ID NO: 1160 - protein, 1395 aa, Artificial Sequence
  Cas9
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENALFNDRDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPNDYKKVFGYNKNEKNNNNYSAYVGVCKTKSKKLVINNTVNQEDFYKFLKPILLAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKNSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDSLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 1161 - protein, 1395 aa, Artificial Sequence
  Cas9
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKVNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 1162 - protein, 1395 aa, Artificial Sequence
  Cas9
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDGLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKFNRLTRATPISDDETAKFIARQLVETRQATKVAARVLEKMFPETKIVYSKAETVSMFRNKFDIVKCREINDFHHAHDAYLNIVVGNVYNTKFTNNLWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 1163 - protein, 1396 aa, Artificial Sequence
  Cas9
MDSSKQGLRRYHLGLDIGTNSIGWTAIDDHFSLLRVKGKNAIGVRTFKEGETAADRRGFRTARRRLSRRRWRLQFLDEFFAPYLAEVDPNFLARLKQSDISAKDPAKNQEYMGKLLFPDQEAASDGNGYPTLIQMRKAMPAEKAADFPVFNIYQLRYALMNEKRKFDLREIYLAVHHIVKYRGNFLNNTSVDKFKADQIDFNKSFETLNDLFRQVQPIAPFQIDLTKVDELGKLLLDTKQKKLDRQKAVAKLLPLIEDGTDKEIVKAHQQTAREISKLILGYKAKVGLILQNNLDQTLDMSTENSDDQLMQIAEELDDYQMELINQLSLLYSQIMLNEIVPNGETVSASMLNRYYKHRCQLKELKDYGAAQDKKTREQLDHLYAEYIGQIPKDSKFDFTKDLKKLMDKSDLGQKIKDEIEAGDYLPKQRTSANGVIPHQMHQQELDQIIENQKEYYPWLAEPNPVEKNIKNAKYKLDQLVSFRVPYYVGPMITLADQQKTSKASFAWAVRKKAGKITPWNFYDMIDREKSANNFIKRMTNKDTYLLSEDVLPASSLLYQKFTVLNELNNIRVNGRKLQPALKQAIYTDLFQKRKTVNLKTLTNFLAIHEPTLTKPKIEGLSNGRSFNSSLGTYIDMSKILGDSLDDLNYRDDIEKIIEWSTVFEDSEIYGVKLQEIQWLTNEQREKLVRKRYQGWGRLSKKLLTGITDENGQRIIDLMWDTSKNFMQIVHQPVFEEQIAELNQQLLQDADKAPLEVVDDILADAYTSPQNKKAIRQVVKVVADVVKAVGNAPASISIEFARNEDRNKELKNSRRHSIEKLYHETAEKLVKQTNLLEELGNVKDLNDRYYLYFTQAGRDMYDGTPINIDEISTHYEIDHILPQSFLKDNSLDNRVLVKKSENAAKSDRVPAKLYGAKMRAFWKQLKESQLISNRKYLNLTTDPEQVDKYQMQGFVHRQLVETRQIIKLAANIFGSLYPDSAVIETRAELTKQLREKFSLYKVRDVNDYHHAVDAYLTAFAGHYLYQRYPKLRPMFVYGDYAKIYADDLKRLRSVNLFHDLEKDQYNSGTAVNPETKEKIVDVDWLSDYVSKIQHFKYMLISKAVYTQHGQLYGATILPVAQVDKISAPIGIKDDKPVDIYGAYTNEVAAYMAIVRVNGKKPKYKVVSVPVRMLQRLKMAEQKGHDQYMQTLHDVLLRNFTSLKKNRKTGLKEAVVKDFDVLVPCVRYNQLVIDGDTKFTLGSATYQHNAKQLVLCNHSLETLANNFEYVRKHPDEADERMIMLYDDILDQVNHYFTLYDKNKFREKLNAGRDKYLKLPTFSQFENNKKTAIGKSEAIINILRGLHANAAITNLKCLGVSTPFGQLQSPSGIELSENAKLVYQSPTGLFSREVLLKDL

SEQ ID NO: 1164 - protein, 1396 aa, Artificial Sequence
  Cas9
MANLRNYKGDYNIGLDMGTGSVGWAVTDSEGKLLHFKKQPTWGSRLFDSAETAASARIPRGQRRRYVRRRWRLDLLQQLFQDEVSKADPEFFIRLRQSRLLKEDREEGHRDYNHPLFNDSDFTETDYYNRFPTIYHLRKWLMETDEKADIRLVYLAAHNIVKHRGNFLRQENTSLSAKNARPLDALREFRSALVDWCAELGYECNPDESGEISNEILSVLEEEHVANSDKKKRISSLIGVAMNEGAKESKACNDALAGAMVGLKAEFKNVFGEISAEQTSIYLSNDEAVDALREGIPDEGLELFGKLCSVYSAYVLQGLLSYAPGQTISVNMVAKYEKYGNDLKTLKALVCEYARAEYDSFFRGEFYRDQDGHELNIYNASKAQGYTRYNLGTSKMSYEDFEKAVKKLFAGTAAEEDGRYLQMMKEFGEQRFLRRLKTSDNGSIYYQLHLEELTAILSNQGKHYPFLVEDAEKIKSLVSFRIPYYVGPLTDRNARKDKHGKNRFAWSERKSGMEDAVITPWNWDEVIDRGKSAEAFITRMTGMCTYLQGEDVLPKCSLLYEEFCVLNELNGSRWGMDGDKEHRFDAADREAIIEELFKKKKTVKYKDVANWLEREAGRMNVHVMGGQGETGYESKLSSYYFFRRDIFDVEELDRADYPMIEQIILWNTLFEDRRILKEKLEDAYGPKGNGRLDDDQIKKICRKRFTGWGRLSKKFLTGIKVDTDCGPRSIMDVLREGDPNAGFRGKTMVMMEVLRDENLGFQQKVDEFNKNYFGQKGKALEVNELPGSPAIRRSLNQAIRIVDEIAKIAGKDPESIFIEVTRDDELDKRGKRTKRRYDALKEALTVFKKEDPEIWAELQATSPSDLDERLTLYFMQRGKCLYSGEPIDINKLSSGEYEVDHIIPRSYIKDDSLENKALVCRKYNQSKTDAMLLDPSIRRKMRSYWDMLLDAKLIGPKKHRNLLRDHIDEKAMKGFVARQLVETSQSVKLAGSLLSVRYPNANIVPVKASMSHDLREAAGFVKCREANDFHHAHDAYLACRMGLFIQMRHPKVYENPIAMTRVMQKYAQQQSKEFNRNHRVPGTSGFIVNSFMSSGFDKETGEIFKDTWNAETEIEGIRKALNYRQCYISRMPMEDTGAFWNATVYSPRDPKMGPKLALPLKKGLDPKKYGGFSSQQFAYFFVYEARDKKDKQVFRFAEVPVWLASQIESDKIALERYATGLAEAEKLKFVRIERAKILKKQLIEIDGDRFILTGKKEMRNGRELALSQKETLNLIVAGDENASLDDRGNASDAVFDAIVRQGDEIGLRLYKQLKIAEIAERYRSVGADAKVGAVMSLLSSINASSNMVNLSMVGGSKYAGNLQPNYSNLLSDPETNFVIIDQSVTGMFERRTRIGL

SEQ ID NO: 1165 - protein, 1396 aa, Artificial Sequence
  Cas9
MTKPYSIGLDIGTNSVGWAVITDDYKVPAKKMKVLGNTNRDYIKKNLLGALLFDGGETAEGRRLKRTARRRYTRRKNRLRYLQEIFAEEMMQVDESFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQANFKTNFQLSEDAKLQFSKDTYEEDLEGLLGEVGDEYADLFVSAKNLYDAILLSGILTVDDNSTKAPLSASMVKRYKEHKEELAAFKRFIKEKLPKKYEEIFKDDTKNGYAGYVGADKKLRKRSGKLATEEEFYKYVKGILNKVEGADYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKELERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPTNIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGIKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSILIHQSITGLYETRIDLSKLGED

SEQ ID NO: 1166 - protein, 1396 aa, Artificial Sequence
  Cas9
MKRVNEDYILGLDIGTNSCGWAVTDKKNNLLKLRGKTAIGSHLFEEGHTAADRRGFRTTRRRLKRRKWRLRLLEEIFAEPMAKVDPGFFVRLHQSWVSPLDKDRKKYNAIVFPTAKEDQAFYKHYATIYHLRDELMTQDRQFDLREIFLAIHHIVKYRGNFLQDTPVKDFEASKIEVGPILSHINNAFAEKIVEDQDPIELNVANAADIEDVIRGKDAEKTVYKLDKVKKIAKLLTDSTAKEEKNVAKQIANAIMGYKTQFETILDKEIDKSDKAQWEFKLSDADADDKLDALLPDLDETDQTVVAEIEKLFSAITLSTIVDENKSLSQSMVEKYKKHKKDYKKLKKYINTLQDQTKAKKLLLAYDLYVNNRHGRLLEAKKTFEDKKKKKALTKDEFYKIVKDNLDDSDLAHEIQQEIAADNFMPKQRTNSNGVIPFQLHQIELDKIIANQGKYYPFLAAENPVEDHRKQAPYKLDELVRFRVPYYVGPMITADEQEKTSGKSFAWMVRKEDGQITPWNFEQKVDRQESANKFIKRMTIKDTYLLSEDVLPANSLLYQRFEVLNELNNIRINGSRISVDLKQQIFNDLFEEKKTVTEKSLTSYLKQNLHLPTVEIKGLADPTKFNSSLASYYHLKSLHVFDKELADPQYQKDFEKIIEYSSIFEDKKIFQDKLHAEFKWLTPEQFKAISTWRLQGWGRLSRKLLVELHDTNGQNIMEQLWDSQKNFMQIVTEPDFKDAIAKENQNVTRANGVEEILADAYTSPANKKAIRQVVKVVADVVKAAGGKKPAQFAIEFTRDPDKNPQLSHIRGTKLLKAYQETAGELVDQKLTDSLKEAMTSRKLLKDKYFLYFMQAGRDAYTGQKINIDEVSTNYQIDHILPQSFIKDDSFDNRVLTATPLNAEKSDDVPYKRFANNYVSDMKMTVGEMWKHWQKAGIINKHKLGNLLLDPDRLNKFQKSGFINRQLVETSQIIKLVSVILQNKYPDAEIITVKAGDNSALRQRLNLYKSRDVNDYHHAIDAYLSIICGNFLYQVYPKYRPYFVYGKYKKFSQDPDLQKEVIKHFKGFTFMWPLLQKDNSERKAPEKIKENNSDRIVFYKHPDIFDKLRKAYNYKYMLVSRETTTENSGLFDVTIYPRGERDLAKTRKLIPKSNGLDPKIYGGYSGNTDAYMVIVKIDKGKESIYKVIGVPMRALASLNRAKKQGNYKEELHQVLEPQIMFDKNGKPKRSVKGFRIIKDHVPFKQVVLDGDKKFMLNSSTYEINAKQLTLTPETMRIVTDNLKKGEDQDQLLVKAYDEILQKVDQYLPLFDVNKFRNSLHLGRAKFLDLAVNDKKITLTNILNGLHDNLVTPDLKNIGIKTPLGKLQVPSGIVLSSEAILIFQSPTGLFEKRVRIADL

SEQ ID NO: 1167 - protein, 1397 aa, Artificial Sequence
  Cas9
MKDYNIGLDIGTSSIGFAAIDDDNNLIRVKGKNVIGSRLFAEGKTAAERRGFRTARRRYNRRKWRLKLLDEIFYEEIIHIDPEFFNRLKQSSISPKDESKKYFGSLLFPDKTDSAYYHDGNQTIYHLRNRLVHQKEKADIREIYLALRHIVKYRGNFLDSTPVSSFEADNLKLDELVPVINDMYENIDIDFSINVDNISEIEKVLLDNHLKSADKQDRLKELLYDNPEYPDDKVKQKEISKFRKDLDKEIIKVIVGYKFNAYKIVNYIPDDGSKFSFSFSDESSDDKLDDLSEVLDDSQMEILNTLKVIYSRVRLNQIIPNGMGLSESMVAKYNRHHEQLEDLKELLDVLPNDEKRSIEYAYTAYIGNVDKQKYNNNLVASLKDLPIKGDINKKIQAVFEYAKGHISSQDLYDVIKTIIIDKYLEDESFEYHDLVERISNDIDNKDYLLKQRSSQNGNIPHQVHQMEMDKIIANQSQYYPFLGVLNPNESRRHIAKYKISELVSFRVPYYVGPLITPEEQEKTSGKHFAWMKRKEAGKITPWNFEEKVDKEATAAKFIKRLTVKDTYLLNEDVLPDNSLLYQQFKVLNELNIVKVNNKRLTLSEKQGVYNDLFKNTKSITVKRLKNYLISNYKHLENIEITGLSDGDKFNNSLGTYNDFKKIFGARIDDVNYSADFENIIEWSTVFEDRSILKEKLEKDIDWITPEEIKAVVAKRYSGWGRLSAKLLTELLDDDGQRIIDILWNDSITFMEAVSKPEIKAQIQNINRDFIKATDIETVLDEAYTSPQNKKAIREVYKLVKDIQKAMGGKAPSSISIEFTRSPEDNGSVTKTRYNNMQNKYKELGKELSDDLSAQLKEYKGRMDQDKFYLYFMQMGKDLYDGSTINLDDLNSYQIDHIVPQSFYKDDSIDNRVLTHYTNNQKKGNHTPLNGLNIDAQTQNLWKHLNKLGLISKKKLQNLCFKDINQLSKYTKHGFVRRQLVETSQVIKLVANILSDEFANDGTKIIEVKAKMNSLMRDTFNLYKVRQLNDYHHAVDAYLTTFVGKYLYKRYPKLRSMFVYGDFKKFSAEDDLKDIKTFNFLHDITNPKESNKEKIYDEKSGELILDRKHAIETIKKIYQYKFMLIVREVSTKSGQLFKQTIYSAKKTNGLKSAIPVKSNLEPSIYGYRSGNVDHHMVIVKIKKGTKYSFKVIGISARAIQELEIAKKIGNYRDKLYEVVSDRLSQSMKSVESFRIILDNIMYGQLIVDGNDKFTLGSADYRKNSRQLVLCTNSLKILKDEDYMNRLSDIQRSKLMVQVYDEIIKIMKNKYSLFISNTEKLLEKRDIFCGLSFDEQKIVIWKIIIDLHNGPFTKIQELGINNKMGTFQTKHGIILTENAIVIYQSPSGLFERKVRLKDL

SEQ ID NO: 1168 - protein, 1397 aa, Artificial Sequence
  Cas9
MKKVLGLDLGTNSIGWALVNEATKEEKKEGKSSEIIKLGVRVNPLTVDEKTNFEKGRPLSTNADRTLKRSARRNLQRYKLRRRNLIEILIKNGFITKDTPLTETGKDTTHQTLKLRAKSAKEKVDLKDFAKILLTINKKRGYKSSRKVNSDEDGLAIDGMAVAKHLYEQNLTPGQYVLNLLQKNKKYVPDFYRSDLQEEFKNIWNNQKTYYFDILTDTLFEELKDKNKSQTWAICKKPFDIAGIKQIGKASDKRLERYKWRTEGLTQKLNLEYLAIALQEINNDINKSSGYLGAISDRSKELFFNKETVGENLYRQLVKTPHTSLRNQVFYRQDYLDEFETIWETQAKFYPQLTHTLKEEIRDVIIFYQRKLKSQKSLISFCQFESWEQTYIEKETGKSKTRTVGRKVIPKSSPLFQEFKIWQNLNSLEFRNSDEGEIIEFIKLDEDIRQTVFEELNLRGNLKPNDVLKILGNYISLGKVSQWKCNFEEIEGNRTNAALYNVYQIIAENEGYGFDWAKKTASEINKELKNIFPQLGIDASILDFDFTQANFDKQTSYQLWHLLYSAEEDFKISEEDKVLYGNSSVSLKKKLHQKYGFKPEYTKLLTNISLQPDYGNLSAKAICNILPYLKENNVYSEACDLTGYNHSNFLTAEEQAKRPLKPILELLKKNSLRNPVVEKILNQMVNVVNQVIETYGKPDEIRIELTRELKKSAKERANMTKSIADATRRNDDYRKTIIKEFGIPNPTKSDVVRYRLWQELASRGYKDIFTDTEIKPQELFSNKIDIEHIIPKALLFDDSFSNKTLAFKKDNLKKANRTAYDFIANDYAPNLENYIERVESLHKDRKITRAKRNKLLMLQSKLPDGFIERDLRNSQYITKEAKKMLYEVCRTVVSTSGSITDKLREDWDLINVMKELNFPKYKALGLTEKIERYDIGAEKMKEVEIIEDWNKRNDHRHHAIDALTVAFSTHSHIQYLNHLNARRDEGHKKHAAIIAIESTITEKEGNKKRRFIAPLPNFRLQAKEHIESILVSFKNKNKVVTNNINKTKRIKKDKFNTKVQLTPRGQLHKETIYGKIKQPLEKHIKLNKSFTLEQAKLIIDKRQREKVLNHLEKYAHNSDIAFNSKTLKKNPLLISDEPLKEVLCFEEVFTIRKDISYDNFKNEKQLDKVIDEKVKQALKERINQYNGDFREAFSDIERNPIWLNKAKGICVKRATIKGVSNAEPLHTAKNHLGEEVLTENKEQIPVDYVSTGNNHHVAIYEDEDGNLQEKVVSFYEAVIRVNEGLPIIDKEYNKSLGWTFKFTMKQNEMFVFPSEDFNPTEIDLLDQKNASLISPNLFRVQKFTIKDYFFRHHLETTVENNNTLKNTTWRREGLSGIYGIIKIRLNHLGEIVQVGEY

SEQ ID NO: 1169 - protein, 1397 aa, Artificial Sequence
  Cas9
MNENKEWFLGLDIGTASVGWAATDTNYNLLKLKGKKSWGVRLFDEAQTAKERRDCRSKRRRLARRKWRLGLLEELFAEEINKIDPNFFMRLRESKYKVSDKTGNVPSILFNEKNYTDKEYYRNYKTIYHLRADLIHKNNPDIRELFLAIHHILKYRGHFLFAGQQFKGSEIKDNIRELLQYNSLNIKIDITDELINNIAEILLKKKNSTDKIIEFKKLFADEKQLIEALRLALGNKTQLAKLFDIEAYKELDISIKTISFKEKIYEDVRSNYEEILGEYIIVLDTAKLIYDAIILSKIKIKNMTISESKVVSYEKHGKDLKQLKHLIKEDCKLSKKEKRQLFENIFVKEDEKGANYVNYIGKNNAGSSKSSCSYEDFKKFLTKELKCCEESKLKQDILAELELETFLPRQRTKDNSVILYQIHKEELEKILNNAVQYHPFLNNTDEYGISIKEKIIQLLEFRIPYYVGPLNTSHKVGDGGFSWSVRNKGYEHIAVTPWNFNKVINKEESAKNFIENLTNQCTYLLYEDVLPKHSLLYSEFALLNELNSINYGGKRLTVEHRNLIIERFFKQSAPKATGKELKKFLMSEGVIDGKDELSGFDVSIKNDLKSYRDFKKILGDKFDSEKVEKMIRWITLFGESKQLLVDKITKEYGDIYSLEEIKKISGLTYKDWGRLSEKLLTEIVSSQLYDESTGECFNIINAMRNNTLLFMELLGTNYDYFEKINIYNRRLRKEITEITPHILDDLYVSPAVKRSIWQVVRIVEELKKIIGSEPKRIFVETTRSNKEKKGDDGRKDSRKKALLELYKKIKTSDIVELEKALGHTVDFDKKKQDLTDIDNNKLKARKLYLYYTQLGRCLYTGKAIDLNNLLSSNSEYDVDHIYPQSKTKDGSWNNLVLVNKTENSKKSNGLISESIQRKNKHFWRFLKAKNLISEEKYKRLTRTEDFTDDELSGFIARQLIETSQSVKAVSQILQNLNPTTEICFSKAENVHDFRQEFGKIKVGKRRNLTEEQQKEAKEGQLIKVRDLNDLHHAKDAYLNIVVGNVYHIKFTRNPKNFIRKNSKNREYTLNTLFYSDKIERNGEVAWEKGKTEKIVSSVMCNNLINVTRRTSEQKGALYDATIYKANAAKEGSYYPVKTKNKNLKDVTRYGGFTSIKIAYYSIFKYDIRNKDKVKENIKIIPIPIYISQNIKTDLDLINFAEKQIKLKKGENIENLQLIYKKLNIGALVKIDYYPYYVGGKTNDNFYIDGAVQVLLSSDIERYLKEVVKFVNFQRENKEAKVSKEHISSEENIELYNTLLCKMTAKIFTHTKNNKYNDLAQDKAKNTFKNLSLEEQCKVLLEILNLLTNKKTTFDLSLINEKASRVKCGFNLLNQKQFSIIEQSVTGLYEKEIKIIED

SEQ ID NO: 1170 - protein, 1398 aa, Artificial Sequence
  Cas9
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYNDQDYFKEYPTVYHLRSELMKSGTDDIRKLFLAVHHILKYRGNFLYEGATFDSNASTLDDVIKQALENITFNCFDCNSAISSIGQILMEAGKTKSDKAKAIEHLVDTYIATDTVDTSSKTQKDQVKEDKKRLKAFANLVLGLNASLIDLFGSVEELEEDLKKLQITGDTYDDKRDELAKAWSDEIYIIDDCKSVYDAIILLSIKEPGLTISESKVKAFNKHKDDLAILKSLLKSDRSIYNTMFKVDEKGLHNYVHYIKQGRTEETSCNREDFYKYTKKIVEGLSDSKDKEYILSQIELQILLPLQRIKDNGVIPYQLHLEELKAILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKVVKEHLIEAVFKQDHKKMTKNRIEQFLKDNGYISETHKHEITGLDGEIKNDLASYRDMVRILGDGFDRSMAEEIITDITIFGESKKMLRETLRKKFASCLDDEAIKKLTKLRYRDWGRLSQKLLNGIEGCDKAGDGTPETIIILMRNFSYNLMELLGDKFSFMERIQEINAKLTEGQIVNPHDIIDDLALSPAVKRAVWQALRIVDEVAHIKKALPARIFVEVTRSNKNEKKKKDSRQKRLSDLYAAIKKDDVLLNGLNNEIFGELKSSLAKYDDAALRSKKLYLYYTQMGRCAYTGEIIELSLLNTDNYDIDHIYPRSLTKDDSFDNLVLCKRTANAQKSDAYPISEEIQKTQKPFWTFLKQQGLISERKYERLTRITPLTADDLSGFIARQLVETNQSVKAATTLLRRLYPGVDVVFVKAENVTDFRHDNNFIKVRSLNHHHHAKDAYLNIVVGNVYHERFTRNFRAFFKKNGANRTYNLAKMFNYDVNCTNAKDGKAWDVKTSMDTVKKMMDSNDVRVTKRLLEQTGALADATIYKATVAGKAKDGAYIGMKTKSSVFADVSKYGGMTKIKNAYSIIVQYTGKKGEVIKEIVPLPIYLTNRNTTDQDLINYVASIIPQAKDISIIYGKLCINQLVKVNGFYYYLGGKTNSKFCIDNAIQVIVSNEWIPYLKVLEKFNNMRKDNKDLKANVVSTRALDNKHTIEVRIVEEKNIEFFDYLVSKLKMPIYQKMKGNKAAELSEKGYGLFKKMSLEEQSIHLIELLNLLTNQKTTFEVKPLGITASRSTVGSKISNQDEFKVINESITGLYSNEVTIV

SEQ ID NO: 1171 - protein, 1398 aa, Artificial Sequence
  Cas9
MEKSYSIGLDIGTNSVGWSVITDDYKVPAKKMRVLGNTDKKYIKKNLLGALLFDSGETAEATRLKRTARRRYTRRKNRLRYLQEIFAKEMAKVDESFFQRLDESFLTDDDKTFDSHPIFGNKAEEDAYHQKFPTIYHLRKHLADSQEKADLRLIYLALAHMIKFRGHFLYDNFNDDNFDWRNIDIQKRYEEFIETYDSTLGESYLADISVDAASILEEKVSKTERLENLLKYYPTEKKTTFFGNLIKLILGQQAKFKAIFNLEDEISLQFATPTYDEDLEELLGKIDNGDSYSELFVAAQNLYNTILLASFLKTDNKSAKAPLSTSMIERYENHKKDLAKLKDFVKKNCPDQYHDIFRDKSKNGYAGYIDNGVSQNDFYTFIGKCLEESLKKDKGAQYFLDKIDRDDFLRKQRTFDNGAFPYQIHLQEMHAILRRQGDYYPFLKENQDKIEKILTFRIPYYVGPLARKDSRFAWANYRSDEAITPWNFDEVVDKEKSAEKFITRMTLNDLYLPEEKVLPKHSLIYETFTVYNELTNIKYVNDQGNAIHFDSELKEKIFNQLFKENRKVSKKTLIDFLNNSEGIYTDKLVGIDEEVKYLNASLGTYHDLKKILESFMDDEINEKIIEDIIQTLTLFEDIEMKRQRLQKYDDIFTPKQLKELARRNYTGWGRLSYKLINGIRNKENNKTILDYLKNGNRNFMQLINDDRLSFKQIIIDARKIEKLDNIESVVYNLPGSPAIKKGILQSIKIVDELVKVMGHNPDNIVIEMARENQTTNQGKNRSQQRLKRLQDSMSNFKDSSISLKDVDNSDLQNDRLFLYYIQNGKDMYTGEELDIDHLSDYDIDHIIPQSFIKDNSIDNRVLTSSAKNRGKSDDVPGRDVVLKMKPFWKKLYDVKLISKRKFDNLTKSEHGGLTESDKAGFIKRQLVETRQITKYVAQILDGRFNTKRDDNNKVIRDVKVITLKSSLVSQFRKDFGFYKVREINDYHHAHDAYLNAVVGTAILKKYPKLAPEFVYGEYKKCDVRKLIAKSGDKSEIGKATAKYFFYSNLMNFFKRVIRYSNGMIVVRPVIEYSKDTGEIAWDKEKDFKTVCKVLSCPQVNIVKKVEKQSHGLDRGKPKGFYNANPSPKPKKGSKVNLVPIKANLNPKNYGGYAGISNSYAVLVDATIEKGAKKKLTRIQEFQGISIIDREKYEKNKVEFLKGLGYKEIYSIITLPKYSLFELADGSRRMLASILSTNNKRGEIHKGNELVLPAKYIPLLYHANRIHNTFETGHREYVEKHIAEFKEIAEIILEFNNKYVNAKKNSSIIEKALESFDSFSLDEICDSFVGKLKKNNTKKNSGLFELVSLGSASDFEFLETKVPRYRDYTPSSLLNATLIHQSITGLYETRIDLSKLGEE

SEQ ID NO: 1172 - protein, 1398 aa, Artificial Sequence
  Cas9
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYTDQDYYKAYPTIYHLRAELMKDGTYDIRKLFLAVHHILKYRGNFLYEGASFDSNASTLDDVLKQALENITFNCFDSSAAIGSIGQILMETGKTKSDKAKTIERLVDTYIITDEVNASGKTQKDQVKEDKKRLKAFANLVLGLNASLIDLFGSVEELEEDLKKLQITGDTYDDKRDELAKAWSDEIYIIDDCKSVYDAIILLSIKEPGLTISESKVKAFNKHKDDLAILKSLLKSDRSIYNAMFKVDEKGLHNYVHYIKQGRTEETSCNREDFYKYTKKVVEGLPDSKDKEYILSEIELQTLLPLQRIKDNGVIPYQLHLEELKVILAKCGPKFPFLNEVADGFSVAEKLIKMLEFRIPYYVGPLNTSHNVDNGGFAWAVRKASGRVTPWNFDDKIDREKSAAAFIKNLTNKCTYLLGEDVLPKSSLLYSEFMLLNELNNVRIDGKPLETKVKAHLIKAVFKQDHKKMTKNRIEQFLKDNNYIPEKHKPEITGLDGEIKNDLASYRDMVRILGNNFDLSMAEEIITDITIFGESKKMLRETLRKKFASCLDDEAIKKLSKLRYRDWGRLSKKLLNGIDGCDKAGDGTSVTIIEAMRDFSYNLMELLGDRFLFMERIQEINDKLTEGQIVNPHDIIDDLALSPAVKRAVWQALRIVDEIVHIKKALPARIFVEVTRSNKAEKKKKDSRQKRLSDLYAAIKKDDALLSGLTNEEFGGLKSELAKYDDAALRSKKLYLYYTQMGRCAYTGEVIDLSQLNTDNYDIDHIYPRSLTKDDSFDNLVLCKRTANAQKSDTYPISKEIQKAQKAFWIFLKQQGLISERKYERLTRITPLTADDLSGFIARQLVETNQSVKAATTLLRRLYPDIDVVFVKAENVTDFRHDNNFIKVRSLNHHHHAKDAYLNIVVGNVYHEKFTRNFRAFFKKNGANRTYNLAKMFNYDVKCTNAKDGKAWDVKTSMDTVNKMMTSNDVRVTKRLLEQSGALADATVYKATVAAKAKDGAYIGMKTKSSVFADVTKYGGMTKIKNAYSIIVQYIGKKGEVVKEIVPLPIYLTNRNITDQDLIDYVASITPQAKDISIIYRKLCINQLVKVNGFYYYLGGKTNSNIYIDNAVEVVVPANIAVYIKVLEKFALLHKDNNNIKASTVTTRIYNEGSTNIVSITDKDGLIVYDYLMSKLRTPLYMKMKGNKVDELSTVGRSKFMNMTLEEQSIYLLEVLNLLTNSKTTFDVKALGITASRSTIGVKIHTLDEFKIINQSITGLYSNEITIV

SEQ ID NO: 1173 - protein, 1398 aa, Artificial Sequence
  Cas9
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLSNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 1174 - protein, 1399 aa, Artificial Sequence
  Cas9
MKTILGLDLGTTSIGWALVKEAEPFSDEKSEIVRLGVRVIPLTVDERTSFENGKSITTNALRTQKRGMRRNLQRYKLRRQALIEELKSTGWIGNDFIFSETGPGSTFRTLRLRAKSASEEVTLGDLARILLQINKKRGYKSSRKMVSSDDGQAIDGMAVAKEMYDKGLTPGEYVYQRMLEGKYAIPEFYKSDLQEEFDRIWALQKSFHIELTDELYRKLSDRNKSQTWAICRDELGIQGLKSSFIGKERLKEAYRYRHLAATQEVNMEVLTCALQEINGQKASLSGLLSKISDRSKELYLNNLTVGQMLLKRIEDNPNNSLKNIVFYRQDYLDEFERIWTVQSKYHTELTHELKKRLRDIIIFYQRPLKSQKGLISLCELETKDIEVAIDGVKKMKNIGPRVCPRSSPLFQEFKIWQTINNIFVNGAALDDEDKSVIAKELMFKDKLKDSDLLKLLFKTTKGQSVNFKEVDGNRTMATLMKACFKIAENLGYDDIGLSKLSSEDQMVRIEGIFKEQGFKTGFLHFDSSLASPEFENQDSYRLWHLLYSYEGDKSASGNESLVKCIMDLCSMDEGSAKILASCTFLPDYGSLSAKAMRKILPYMKDGLEYTAACAMAGYRHSKRSLTKEELDTKEYSDRLSLLPKNSLRNPVVEKILNQMINVVNSVIDVYGKPDEIRIEMARELKKSAKEREEAQRDIASSTAESQKVIEILKGEPFFLQFPTRNDIIRYRLYQELAQNGFKTLYSNTYIPKDKLFSKEFDIEHIIPQALIFNDSFANKTLESRQCNLEKGKETAMDYVKSKYDETGVQTYCDRVNGLIGKGISKTKAKWLLMEGKDIPEDFINRELRDSQYIAKKAREILESLVKFVVPTTGSVTARLREDWQLVNVMQELNWEKYARLGLTGVREDKDGRRIPFIQDWTKRNDHRHHAMDALTIAFTRRQFIQYLNHLNSKIDVVSWDKKDLDLRDYDLEDIKFGNLSAGDRYGIVKALQDKFLYKDGNDKYRFVPPIPLDEFRRQAKEQLSDILISFKAKNKVCTRNVNVTKNKGGANRKAQLTPRGPLHNETIYGSSLEYVTKENEKIGSSFDTERITTVCKKKFRDALARRLEEFGGDPKKAFTGKNSPEKNPIWVDEHHSEQVPAKVRTVTMGQRFTGRKPIDATLKIEKVIDKRIREILQARLDEFDGKAAKAFSNLDENPIWLNKEKGIAIKRVTVSGPANPVPVRFKRDKDGKPIIDDAGKTIGADFVTPGNNHHIAIFRDSSGKLQEHPVSFLEATIAKSHGLDVIDRNYNKDEGWEFLFTLKQNEYFVFPNSETGFNPLDYDLTDPRNYAEISPNLYRVQSISTNDYFFRHHLETTSEKNNSLYGITWKRIRNASALEGLVKVRIDNLGRIVAVGEYD

SEQ ID NO: 1175 - protein, 1399 aa, Artificial Sequence
  Cas9
METQATAQLISGHLKGYPIYDYFVGLDIGTNSVGWAVTNRIYELLKFRSHKMWGSRLFEEGQTAVVRRGFRSIRRRLERRRLRLKLLEALFADAMARVDSTFFIRLRESKYHYEDKTTGHKSKHILFIDDNYTDQDYFAEYPTIYHLRADLMENGTSDIRKLFLAVHHILKYRGNFLYEGATFDSNSSLDTVLKRALEQIEFHIFNATSEDALHSILDIVKLQDKTKSDKAKAIESLVDTYITDKVESSCTDKEKKDLLKADKKRLRAFANLILGLNANLTDLFGTIEEIEEDFVKLQITGDTYEEKRDDYAKVWGDTIRIIDDCKSVYDSIILMSIKEPGLTISQSKVKAFNKHKEDLAILKRLLKSDKYIYKNMFKADEKGLANYVHYIKQGRKNETGCSCEDFYKYTKKVVESLPDSSDKAYILNEIELQKLLPLQRIKDNGVIPYQLHLEELKAILEKCKDTFPFLNTVSDGFTVAEKLIKMLEFRIPYYVGPLNPSHSIDKGGFAWVERKEPGQVTPWNFEDKIDREKSAEAFIKNLTNKCTYLIGEDVLPKSSLLYSEFMLLNELNNLRIDGKPLEQAVKMHLIDAVFKKEHKKQTKNRIIEFLKDNNYILGKHKPEVDGLDESIKGDLASYRDMKRILGDDFDVSMAESIITSITIFGESKNMLRETLRKKFGSILSEDQIRSLAKLRYRDWGRLSKKFLIGIDGCVKGEDGTPGTIIDMMRNTSHNLMELLGDTFSFMDVIIEENDKLTKGQVVDPHEIIEELGLSPAVKRAVWQALRIVDEVIHIKKALPSRIFVEVARTNKDEKKKKDSRKKRLQELYKSIQKESPEWLSVTRDESDKLISNLDRADDSSLRSKKLYLYYTQMGRCMYSGRVIDLDQLNTDKYDIDHIYPRSLTKDDSFDNLVLCERQENAKKSDNYPIDPDIQNARKPFWTFLKDQNLISSRKYERLTRVLPLEADDLTGFIARQLVETNQSVKAVTTLLRRLYPGVDVVFVKAENVTDFRHDNDFIKVRSLNHHHHAKDAYLNIVVGNVYHEKFTRNFRKFLKKNGAKRTYNLARMFDFDVMSTNAKDGKAWDIKTSMNIVKKMMASNDVRVTKRLMEQKGALSDATVYKASVAGKAKGGAYIGMKTKDSVFSDVSKYGGRTSIKNAYSIVVEYTGKKNEIIKEIVPLPVYLINRNKTDQELIHYIVSIIPQAKNVSIIYKKLCINQLVKVNGFYYYLGGKTNNYFWIDSAIQVVIADEWIPYLKVLEKFDVMRKQNKELKVGTVSTSIQNQGKKVVIKILEERNVEFFSYLVGKLHSSIYSKMKGNKAGELATKSLEIFVNMSLENQCIYLMELLNLLTNKKAPDVKPLGITASRGTIGSKVSNQDEFKIINESITGLYSNEVTIV

SEQ ID NO: 1176 - protein, 1399 aa, Artificial Sequence
  Cas9
MNLRNTTDEYNIGLDMGTNSVGWAVTDKAGAIAHFKGKPTLGSRLFDAAQTAAGARIHRSQRRRYVRRRWRLDLLQSLFQDEVSKVDSEFFCRLRQSRLYVGDREKGHADYTWPIFNDSDFNEVDYYKRFPTIYHLRKWLMETDEKADIRLIYLATHNIVKHRGNFLRENNKSLSSRDANPAQAVKSLRLALNDWCSERDYECAWKGEEDDGAIDEAILNVLADGEKGRSDQAKEIAKLTGVDCGDAKQSKQCNEAIAKAIVGLKVEMKNIFGEFPAEKTSYIYLSSDEDVEAVRESCPDDSGELFQALCKLYSAYILQELLSYADPSGQTISANMVAKYKQYGRDLRLLKELTRTYAPQKYDLFFRGETYAGSSDYVVDEARGYTRYNLGTTKANYDDFQKSVKELFKGTDALQDERYQEMMVAFGEQKFLRRLKTSDNGSIYYQLHLEELHTILENQGKHYPFLLSEEDKIESLVSFRIPYYVGPLTRKNAAIGHDGKERFAWSSRKDGMEHAVITPWNWEEIIDRDKSAEDFIMRMTGDCTYLQGEPVLPKCSLLYEEFCALNEFNGAHWTVDGDDERRFDAAQRERIMCDLFRRTRSVTYNKVSDWLERKYNFTGARVRGGQGEHGFESKLGSYIFFCKDVFKTDGLDEADYTMIEQIILWSTLFEDRDILKRKIEEAYGGDRLTSEQIKVICKKRFTGWGRLSKRLLTDIKVNTDTGRKSIMDVLREGNPNNGQRSRTMVFMEVLRDEDLGFQKAIDGLNRDYFREHNNGLMDVNDLPGSPAIRRSINQAVRIVDEIASIARKEPTNIFIEVTREEDDPRKKGKRTKRRYDAIKSALEKFKKDDPSLWKELCEKAPGDMDERLSLYFMQRGKCMYSGRPIKIEELHTGKYEVDHIIPRSYIKDDSFENKVLVYREENQHKTDALLIDSSIRQKMGGYWRMLHDAKLVGDKKFRNLFRNHIDDKAMKGFVARQIVETSQMVKLVQTLFEARYPNTRIVPVKAGISHDLREAAGLVKCREANDFHHAHDAFLACRIGLFIQKRHPSVYDNPIGLARIMRDYARMQAREYKKSHCLAHTQGFIVNSFLSSGFDEETGEIFKDDWDAKAEVEGIRRVLNCRQCFISRMPVEGDTRYGGRYWGETIYSPKGKHKHEIPLKQGLDPNLYGGYSDLLYSYFLIYEASDVSSGERVLRFIGIPTSIAARMANQKRLEEYVSRLALQENLEHVRMVRKIMKKQLIEVDNCRLLVTAADAVTNATELAFSLDEMKIISTCAKCINGADPSAIDKIGNAQDSFFDNLKRRGSDRCALLFSQLKLDKLSQNFYMISSDDKSKILISILDRIRAKSNSVDLSLVGGAKHAAQMKFDFNAKLNNPASSFVLIDQSVTGMFERRTRIGL

SEQ ID NO: 1177 - protein, 1400 aa, Artificial Sequence
  Cas9
MNLRNATGDYSIGLDLGTNSVGWAVTDSNGSMAHFKGKPTLGSRLFDAAETAAGARQHRGQRRRYVRRRWRLDLLQGLFQDEVNKVDSEFFIRLRQSRLHVEDRAEGHAGYRWPLFNDTDFTEKDYYKRFPTIYHLRKWLMETDEKADIRLIYLAAHNIVKHRGNFLREDNKNLSSHNANPAEAVRSLRQALDDWCAERGYVCAWTSVDDLAEADSHILDILTNSKERRADQAKELAKLFGVDCGDTKQSKSCNSALAKAVVGLKTELKDVFGEFCAEKTAIHLSSDDDVEAIRDAIPDDSGELFQVLCAVYSAYVLQELLSYAPGQTISANMVAKYDQYGKDLKLLKNLARTYVSRENYDAFFRGQTYEDSNDYNVDKAQGYTRYNLGTTKASYDDFKKSVEKLFKGTQAEQDKRYQGMMKRFAEEKFLRRLKTSDNGSIYYQLHLEELRAILKNQGKHHPFLLEEEKKIESLVSFRIPYYVGPLSSKNASLDHKGKQRFAWSERRPGMKDTVITPWNWDQIIDCDQSAEKFILRMTGDCTYLQGEPVLPKCSLLYEEYCVLNELNGARWTIDGDDWRRFDVAQREGILHDLFRKTRSVAYNKVADWLEREENWANAHVRGGQGENSFESKLGSYIFFCKDVFKTAALDEADYPMIEQIILWNTLFEDRAILKRKIEQAYGEHHGGKLTDEQIKVICKKRFTGWGRLSRKLLTGIKVDADTGRVSIMDVLREGNPNEGQRSRTMVLMEVLRDEDLGFQKKIDDFNKAYFAGQGEGLMSVNDLPGSPAIRRSINQAIRIVDEIASIAGKAPSNVFIEVTREEDDPRKKGRRTNRRYEDIKNALENFKTEDQELWSELLGKAPNDLDERLSLYFMQRGKCMYSGRPIKLEELHTGKYEVDHIIPRSYIKDDSFENKVLVCREENQRKTNEMLIDPAIRRRMGDYWRMLHKAKLIGDKKFNNLFMRDRIDDKTLKGFVARQLVETSQSVKLVQTLLEVRYPNTKIVPVKANISHDLREAADLVKCREANDFHHAHDAYLACRVGLFIQKRHPSVYANPIGLSRVMRDYARKQAGEFNKTHSMAHTKGFIVNSFMTSEFDKETGEIFWDAEAAVEDIRRVLNYRQCFISRMPVEDTGAFWDQTIYSPRSNKRLELPLKDDLDPNKYGSYSREQFAYFFIYEARDAKKSKTVLRFAQVPVRVTSAIARDSSKLDEYASGLAVQEGLEFTKIIRRRILKKQLLELNGDRLVITGAKEVRNATEFAFTLEETALVAMCSEIAREGVPSEIASDVQSISSQLSDLFLALIERGLTIGVRLHGQLKLGQYLRQFEDAALRDKAKVIIGIISITNGATNTLDLSSLNGSKNVGQVRITHNKLLNDKSTSYVLIDQSVTGMFERRTRIGL

SEQ ID NO: 1178 - protein, 1400 aa, Artificial Sequence
  Cas9
MKTITEDYILGLDIGTNSCGWAVMDKKNRLLRLRGKRAIGSHLFEEGHSAADRRSFRTTRRRLKRRKWRLRLLEEFFAEPMAKVDPAFFVRLHQSWVSPLDKDRKKYHAIVFPTAKEDHEFYHDYPTIYHLRDALMREDRQFDLREIFLAIHHIVKYRGNFLQDTPVNSFVASKIDVASFLTNVNQAYADKYGEEQNFIELNENNAAAIEAVIRGKDKDKTTKQLDKAKKITKLLQSSTNKYEKNVTRQIANAIIGYKTQFETILGKDIDKNDKADWEFKLSDGDADDKLENLLPEFDDNDQYIVAEIKKLFGSIALSQIVYENMTLSQSMKCKYKDHGEDYDLLKQYIATLSDHSQVRKLLLAYDLYVNNRHGRLLEAKKEFKQDKALTQDEFYKIVKENLDDSQLAQKILQKIDEGKFMPKQRVNKNGYIPYQLHQIELDQIIANQSKYYPFLAEENPVKEHRKQAPYKLDELVRFRVPYYVGPLISPDDKRKDEQQNKNHEMFKFAWMKRKDDNGAITPWNFAQKVDRETSANRFIKRMTVKDTYLIGEDVLPARSLLYQKFEVLNELNNIRVNGKRLEPKFKQKVFNELFKQKNKVTKKAFKEFILQNTGMKTAEIDGLADPTKFNSSLSSYYHLKSTKVFDKQLDDPQYQADFEKIIEYSSIFEDAEIYQEKLHKEIKWLTPAQFKAIANWRLQGWGRLSRKLLVELKGKGGENIIYQLWTTQKNFMQIVNEPELKKAIVKENHQATEEKGIEKILDDSFTSPANKKAIRQVIKVVDDVVKAAGGKKPAQFAIEFTREPKWNPHLSNIRGTKLLQVYEDTAKKLVDQSLTDSLRENMTNRNLLKDEYFLYFIQGGRDAYTGKKIDIDDIPKKYQIDHILPQSFITDDSLDNRVLTEIEINQKKGKKYASHLFAPKPAFGLNQSISEMWKTWQKAGLISQRKLNNLLFDPDLVKDKQKKGFINRQLVETSQIIKLVSIILQDKFPDTEIITVKAGYNTALRKELKLYKSREANDYHHAIDAYLTAICDNFLYQVYPNFRPFFVYGQFKKFSQDTDKQKKAVKYYGLKNFLLPLLDDSTGDEVMVNHTKHVVFHKQRDIFNRLIQAYNYKYMLVSRETTTENSNMFNMTIYPRGERDRKKTRKLIPKGKDLDPAIYGGYSGNTDAYMVIVKIEKTKETLYKVVGVPMRALASLKKAQKEGNYDQELNKVLEPLIMFNKNGKSKAGIKGFTVVKDHVHFKQVVIDGDSKFMLYSAQYRANAKQLTLSQETMKVVTDNTDDMDQKNADKDQLLLNAYDEILEKVDQYLPLFDINGFRQGLHDGRAKFAALKTSEKKYTLKNVLNGLHDNLVTPNLKNIGIKTPFGLMQSSSGITLSPNAKLVFQSPTGLFEKRVKLTNL

SEQ ID NO: 1179 - protein, 1400 aa, Artificial Sequence
  Cas9
MGKQKFNDYYLGFDIGTNSAGWAVTDLQYKLLRFNKKDMWGSRLFDEAQTSKERRVYRNSRRRLDRRKKRLKLLEELFLDEISKIDNTFFKRLKESNLYNEDKSIKFNYPLFNDKDYTDIDFYNEYKTIYHLRKDLIFEDKKFDIRLVFIALHHILKYRGHFIFEGQSFEEIKSFDSIFTQLSSYFLENFDFNIDVSIKEKLEEIILSDNTKSIKKTEFKKIFSDNKVLSVLNMAIGSKVSLKDVFNNEELKEQKISFSEIDYENEKRDEFYQLLGEDIFLIDLAKKIYDFMVLKKILKNTDSFSASKVALYCEHKKDLDDLKYIFKKYLTKEDYFKFFRSNVEKINYPSYIGLNKIKSKKIIKENKCSISDINKELKNKYLKDIKLEAKDKELFNRIFNKLDEFKFLEKLKSSENSTVPYQVHEIELKKILDNQRKYYPFLNEKIDGKSVYEKIIQLFEFKIPYYIGPLNTDPNVKGKNTWVVRKDENNKTPITPWNFEQKVDMQKSAEEFIKRMTNRCTYLKAEDVIAKNSLLYEEFILLNELNKVTVDNEILHPTLKTEIINELFKTTVKVTKKKFIEFLKKKQAVNDVESITGIGVEFNCKLQGYNTFRKILGKKIENVNVKNFVEKCIELKCLYGSDKKLFENAIGKIYREYNITDEEFNKINRLNFNKWARLSKKFLTEISFEKTDGTKRFESVIEALRSTNYNLMELLSDKFNLQSKIDEINGEDDFSNIDIKEYVDKLYVSPSVKRSIIQTYKIAMEIKKITKKDPKKIFIEMAKDKGEKGKTTEKRKDKIKKLYKNIKDTLSDYCNNLQDLTLQVEKYDDNRLRQKKLFLYFMQMGKSMYTGRCIDLEDLFNNNVYDIDHIYPQSKVKDDSFDNIVLVEKEENHRKSNELLKEEIQSRMNNYWIFLRENKFISKEKYNRLTRKKDFTDEELGDFVARQLVTTRQSTKEIAKFFEKIFEKTTVVYSKASLVSEFREKYDIIKVREVNDAHHAQDAYLNIVVGNVFNTKFTKNYWKFTKDIKRQNEENPNEKKGYNLRKIYESDVFCNDSVAWVYSKENPKYNTINTVKDMVYRKTANITRMLVEGKGQLFNLTIKDKTQLKKNVGNIVANTPISLKNRKLHLNSVEIAKKYGYFDSLNNAYFVLFKYEEKGKEKIGFDSITIAYKERLKKNLDIEKFLENKGYKNSKLIRKIFKNQKVLINGYPYLLKSFNKQSQIKFNNFKILYLNENNLKFAKDAIKFEKNNANVDLKKQKYIVSFLKKKKQNEINETYEECIDRLNDEFDTLFLKLCDIQKSSIYTNYKLQDFSSNKKSIEIKDKFDIFKSLDLYKKSKLIKEFLNYYKYEKNDLDFSLIDIDKKANCIQKHFTEDLVKDFVIVDESVTGLFVKKERLK

SEQ ID NO: 1180 - protein, 1400 aa, Artificial Sequence
  Cas9
MKTITEDYILGLDIGTNSCGWAVMDKKNRLLRLRGKRAIGSHLFEEGHSAADRRSFRTTRRRLKRRKWRLRLLEEIFAEPMAKVDPAFFVRLHQSWVSPLDKDRKKYHAIVFPTAKEDHEFYHDYPTIYHLRDALMREDRQFDLREIFLAIHHIVKYRGNFLQDTPVNSFVASKIDVASFLTNVNQAYADKYGEEQNFIELNENNAAAIEAVIRGKDKDKTTKQLDKAKKITKLLQSSTNKYEKNVTRQIANAIIGYKTQFETILGKDIDKNDKADWEFKLSDGDADDKLENLLPEFDDNDQYIVAEIKKLFGSIALSQIVYENMTLSQSMKCKYKDHGDDYHLLKQYIATLSDHGQVRKLLLAYDLYVNNRHGRLLEAKKEFKQDKALTQDEFYKIVRENLDNSQLAQKILQKIEEEKFMPKQRVNKNGFIPYQLHQIELDQIIANQSKYYPFLAEENPVKEHRKQAPYKLDELVRFRVPYYVGPLISPDDKRKDKQQNKNHEMFKFAWMKRKDNNGAITPWNFAQKVDRETSANRFIKRMTVKDTYLIGEDVLPARSLLYQKFEVLNELNNIRVNGKRLEPKFKQKVFNELFKQKNKVTKKAFKEFILQNTGMKTAEIDGLADPTKFNSSLSSYYHLKSTKVFDKQLDDPEYQADFEKIIEYSSIFEDAEIYQEKLHKEIKWLIPAQFKAIANWRLQGWGRLSRKLLVELKGKGGENIIYQLWTTQKNFMQIVNEPELKKAIVKENHQATEEKGIEKILDDSFTSPANKKAIRQVIKVVDDVVKAAGGKKPAQFAIEFTREPKWNPQLSHIRGTKLLQVYEDTAKKLVDQSLTDSLKENMTNRNLLKDEYFLYFIQCGRDAYTGKKIDIADIHKKYQIDHILPQSFITDDSLDNRVLTEIEINQKKHKKYASHLFATKPAFGLNQSISEMWKTWQKAGLISQRKLNNLLFDPDLVKDKQKKGFINRQLVETSQIIKLVSIILQDKFPDTEIITVKAGYNTALRKELKLYKSREANDYHHAIDAYLTAINDNFLYQVYPNFRPFFVYGQFKKFSQDTDKQKEAIKYYGLKNFLEPLLDDSTGDEVMVNHTKHVVFHKQRDIFNRLIQAYNYKYMLVSRETTTENSNMFNMTIYPRGERDRKKTRKLIPKGKDLDPAIYGGYSGNTDAYMVIVKIEKTKETLYKVVGVPMRALASLKKAQKEGNYDQELNKVLEPLIMFNKNGKSKAGIKGFTVVKDHVHFKQVVIDGDSKFMLYSAQYRANAKQLTLSQETMKVVTDNTDDMDQKNADKDQLLLNAYDEILEKVDQYLPLFDINGFRQGLHDGRAKFAALKTSEKKYTLKNILNGLHDNLVTPNLKNIGIKTPFGLMQSSSGITLSPNAKLVFQSPTGLFEKRVKLTNL

SEQ ID NO: 1181 - protein, 1400 aa, Artificial Sequence
  Cas9
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKEKGICIKRVTITGVSNAEALHHQKDHLGREILDDNGNPIPADFVSTGNNHHVAIYEDEKGKLQEKVVSLYEAVARANQGLPVVDKGLNEDLGWKFLFTMKQNEMFVFPNDDFDVNDIDLLDENNAKIISQHLFRVQKLATKNYMFRHHLETNVQEVKELNDIAYKSIRSTEPLKNIKKVRINHIGKIVQVGEY

SEQ ID NO: 1182 - protein, 1402 aa, Artificial Sequence
  Cas9
MAKKDYTIGLDIGTNSVGWAIIDDNLKLLKRNMTIKGNTDKKSVKRDLWGSLLYSGNSDKTTSAADARSKRGLRRRLRRRKYRLDRLKQIFSEIINDKAPNFFDKLNESFLNPKDKKYGKYQIFDTEKEEKDYYRRYPTIYHLRKDLIESSKKQDIRLVYLALAHILKSRGNFLFEGNIDDLKNDFAGIYEEVVELCMTINAEDVDLEFEEVDKQSLNSIIKNEDISEIEQGLENFADEHVIFKEQNKKKNDLFSNCCKIICGHTVKANKFASELDSELFISFKSDDYVDVIDVIQSGNENIANLLLACRKAYDYIMFNRLVDLNIDSPAKLSSNMVSLYNQHEKDLKAYKKLIKEFNKFKRSNGCKDLEMIILTADDIDSFRKKVDKKEGKLNGINKKITHEQALKKQLKDMKKILEDKNTEAEDKQINDILKMITSIEERVNKSCFLKNLRSTDNASIPNQIQRQEMEAILDKQAKFYPFLNEHKDELLQLLSFRIPYYVGPLVNKKYSRFAWLVRKEGQVQKITPTNFDGVVDKHKTAEKFMERLIGKDVYLPNERVLPKASLLYQEYCIFNELTKVAYIDSTGKKNNFSSEEKLNIFEKLFKTKREVTKTDLCKCLNNVCKLKEKVKETEIIGIKAKFNAKYSTYHDLKKINGMEQLIADEEGKPLCEDIISILTIFEDKDIRLVRLKELLCQNKDLINKFSLSAEKLAKVLSTKHYKGFGNVSAKLINGIRDKNCKTILDYLIEDDKEAYYGRNNPNRNLMQLVNDSRLAFKGQIDREQNTHLEDLSLDEFLDDLYVSPSIRRGIRLTIRLVDELVEIMGYLPKNIVIEMPREDGEKGKIADTRYSKLEKMLKKDAALEDLYRVLKTYEKNKKALANDALYLYFLQNGRDMYTGKEINLSELHSYDIDHIIPKSFKYDDSLDNKVLTAKKMNMDKRTGALDHNIIENQCGFWRVLLQQDKISLEKYTNLMKTEFTEADKAGFIMRQLVETRQITKFVARYLDNKFNGLISDPNDKVNILLPRASLCHQFRETFGFYKVRELNDMHHAHDAYLNAVIANTLNKNAYLSDLLKYGAYSKYKKNGFNNSNGIMDYFGNTQFNCLFVVERTLDKCRVNIVKHPETASGEFYNETIQKNKVNGGSSTRSLKSSVKVLQNTEQYGGFTNVNNAYFILFDYKAKSKLKRKLIGVPIVDRQKFEQDPVTYLEAKGFDEPKLVQKLLKYTLLEYEDGKRRYLTGVTGKRCELVRANQLLLPRNMMALLHHLQEWQKHDFGIKEMTKVIKNTNNIEAKFDKLFEHMMKFIDKYSEPPKIVSSKISEEYHKLRESLCQDDNKIKIYAEIGKALLSLLHLVDSKSACVFKFSGLEINRIRYQSINEKKEPVIIFQSLSGLRESRYKYNQ

SEQ ID NO: 1183 - protein, 1402 aa, Artificial Sequence
  Cas9
MKLRNAKDYSIGLDVGTGSTGWAVTTLDGDLFTFNHRPTLGSRLFESASTAQETREARGARRRLKRRRWRISLLQEQFAAEMESCDSNFFIRLNQSRLWQEDRTEQGKGYLFGGKPILCGAQIFANEQEYYQQFPTIFHLRKFLVECSEQVDLRLIYLALHNIVKYRGNFLYQDNKTLNVRNFNLDSQIADFLDQLQLWCENNDLCFHEIDGTTTLASQLNTCFHQQSNQQKKDTLKTFFATCIENDKIAGELTKALLGYKTDFKIIFNIEGEKDEYKAKCNEEEKILKLQETIDDANQVLLQSILNLYSGIIVEKILNNTAVKNESAQCTLSAYHCYSYALYSKQLRTLKKLVRKYNPQRYNECFNLSAEDPKAKKQLCTYARYNAQHSTDYDEFKKYIKDLFENTDAVNDAAYQQMKQDFDEEKFLRRQKTSDNGVYPYQFHLEEMQLIIENQAQHYPFLTKIKPKLESLVTFRIPYYVGPLTQKGIQRNGRKFAWSKRNKDAENQRIYPWNWDSIIDKSASAEAFILRMTGKCTYLYGEDVLPKESLLYQEFCVLNELNGARWNCDGERRMPLSNKDCKAIYRQLFLKKQKVSYADVSNYLKAQGHINNSVAGGQGEHGFESTLSSHHFFRKLFNVDAANDLTAQQIETAEQLILWGTIFEDKEIFEQKIKERFGDMFSKDEIKTIARRKFSGWGKCSKQLLSGLTVETPRGRESIIDVLRNGHPENGRTLVFMQVITDKKLEFDKKIEEYNNEHLAKTNESVLDTAIMSPAIKRGVNQALHIVGEIRRITKHDPTCIYIETTRDEKDGKHNTRTSSRYSSLKKNLETLKSIDKANAPAIKHSLELLETYKKQNIDDKLFLYFTQNGKCMYSGKSLDINNLSSYQIDHVIPQSYITDNSFDNRVLVYASENQRKSDSLLLSSVIQAKQEPFWTSLEKAGLISEKKHNNLKRKSLSDAQIKGFINRQLVETSQIVKVLRDELSRILPDTKIIPVKASLSHDVRIACNLYKSRTANSFHHAHDALLASTMGRFVQTRFPDMYENPVRYVKILRAYIAQSKLQHSAQTRNFDSRSFMAHSFFCDYSNENGDTIWNSASEIERLRRALSYKNLYLTRRPFIDAGQFWDQTIYSPHDKKKTPDSLIPLKKNLDTQKYGGYSGKDYAHFFIYSVLNKQGDVEYRFDGVPLYIAANINRDDRGALAQYAKQLVEHENVPNAKRKTKDLVFQRIERACVPKYQLICISQCSGDSDRSVSDYYYITGKKEVRNALQLAFPMHLYGAINAIEDKKELDDSALEELVVYILRNAPRIAPDVFRRLNLTEKLADCLDIPDRIELQNSIYGLFNLINAESNVVNLQIFGGAKTAGVKLINLNSLLNDPATTVTFIDQSVTGMFERKETIGIS

SEQ ID NO: 1184 - protein, 1402 aa, Artificial Sequence
  Cas9
MGKQEFNDYYLGFDIGTNSVGWAVTDQQYKLLRFNKKDMWGSRLFEEAKTAKERRVYRNSRRRLDRRKRRLKLLEELFLDEILKVDSTFFKRLEESNLYNEDKSIKFNYPLFNDKDYTDIDFYKEYKTIYHLRKALVFEDRKFDIRLLFIALHHILKYRGHFIFEGQSFEDIKSFDYIFTEIQDWILENFEINIDINLKEKLEEIILSNNTKSIKKIEFKKIFSDNRILAILNMGVGCKVDLKDVFNNEELKDQKISFTEIDYENEKRDEFYQLLGEGIFIVDLAKKIYDFMVLKKILKNSDYFSESKVALYEEHKEDLNRLKYIFKKYLKSSDYYKFFRSNSEKTNYPSYIGLNKIKTKRLIENNKCSISDINKELKNKYLKDIQVEAEDEELFNRILHKINENKFLEKLKSSENSTVPYQVHEIELKKILDNQRKYHSFLNEKSDGMTLCEKIIKLFEFRIPYYVGPLNTNPNMNKKNKNTWVVKKEENSKSSITPWNFEKKVDEQKSAEEFIKRMTNRCTYLRGEDVIPKNSLLYEEFVLLNELNKVTVDNELLHPTLKNEIIDELFKTTVKVTKKKITEFLKKKQAISDVESITGIDVEFNGKLQGYNTFRKILGEKIENLNIKKFVERCIELKCLYGSDKKLFKNAVGKLYKEYNVTDEEFTKINKLNFNKWGRLSKEFLTGIRFEKTDGTERFESVIAALRSTNYNLMELLSDKFNLQSKIDEINGEDDFSNIDIKEYVNELYVSPSVKRSIIQTYKIAMEIKKITGKNPKKVFIEMAKGGGEKGKRTERRKDKIKELYKNMKDSLSDYCNNLQDLSSQVEKYDDNRLRQKKLFLYFMQMGKSMYTGNDIDLSELFNNNIYDIDHIYPQSKVKDDSFDNIVLVEKQENHSKSNELLKPEIQSKMNNYWIFLRENKFISKEKYNRLTRKKNFTDEELGDFVARQLVTTRQSTKEVAKLFEKIFDGTEVVYSKASLVSDFRERFDIIKVREVNDAHHAQDAYLNIVVGNVFNTKFTKNYWKFIKENNRKNEENPNKKEGYNFKNIYESDVFRNEDVAWVFSKENKEINTIKTVNKMVYRKTVNITEMLVEGKGQLFNLTIKDRTQLKKKVGNIVANIPKSLKNRNTKLKSDELAKKYGYFDSLNNSYFVLFKYVEKEKEKIGFDGITIVDKEKLKKNSDIERFLENKGNKNAKLIRKIFKNQKVLIDGYPYLLKSCNKDKAIRFDNFKSLYLDENDLKFTRDAIKFEKNNADIDLKKQKYIISFLKKKKQNEINETYEECIERLNNEFDTLFLNLCDIQKSPIYKNYKLPDFISKKNVVEVKDKFEVFKNLELYNKSKLIKNFLNYFKYDNNKLDLIAIGIDSKANCIQKHFTEDLIKDFVIVDESVTGLFAKKERLE

SEQ ID NO: 1185 - protein, 1402 aa, Artificial Sequence
  Cas9
MTYRNYHIGLDIGTSSVGFAVRYDNGELVHKKGSNLVGARLFKEGETAEERRLNRGARRRYNRRKWRLNLLNQIFKPLIEVNDPTFFKRLEQSNLVNYDKSESFSLLNNQSDDKLHQQFPTIYHLRDYLMKSTEKADIRLIYLAVHHIVKYRGNFLDASPVDSFEASNLKVDEILTQINLLLDNLTDDLRLNTQYVTDIEQTLLSNTESNKDKEKVIQKLLLHKEAIKIDKDRTAQIAKLVLGYKADIAKLFGITEKLQTPKLELSAANSDDALMELSAELNEDQIGILLQLKTLYSRVRLNQIIPSGTSLSKSMIEKYELHHTQLKSFKENILLKLRRNTAVRRNLELAYALYVGNAQTKQEVFEPKKARFTSDDFASLKANAKSASSVKEAPKNTKTKLTTDDFYNILTELFATFESELSADEDMIKEVEQIKKAITGDNYLPKQRTDQNGNIPHQLHQIELRQILQNQLPHYPEMDKINEQKPIEKLVTFRVPYYIGPLITPEDQQKSSAANFAWMKRKEQGAITPWNFDDKVDRMQSATNFIKRMTVKDTYLINEDVLPDRSLLYQRFKVLNELNLVKVNNQLLSIGEKQAIYHDLFEKQKTVSTKKLQSYLQSEQGYGDNIEISGLSNPDKFNNGLTTYIDFKNIFGDLVEDTTKQKEFEQIIEWSTVFEDRAIFKAKLQEVNWLTEEQIKALVAKRYSGWGRLSYRLLAELVNDNGERIIDILWNNKGSNLMSIVSQDEFQQQIARINSHEVQELGMESVLANAYTSPQNKKAIRQVMKVVDDIQLAMNGQAPTSISIEFTRKPEENSEISKSRYETITSIYQSLSKDIEKEVKDNLNKNKSSLKKNLSDKYYLYFTQLGRDIYTNQPIPFNEIPYYDIDHIVPRSVEMNDSLNNRVLVAKSINQIKKNNAPIDSSLKITSETRQLWKKLLDSGLITKQKYYKLSSSIKNTVSPYVKQGFINRQLVETSQVIKLVANILGTKYQNDDTEIIEVKAHLNSEIRKTFEFYKLRELNDYHHGFDAYLTTLVGGYLYNRYPKLRSYFVYGDHKRLDKAQLSELKNFNFLHGLTNPKSGSDGLITASGSQQVVLDRNETIKRLNKIYRYKYMLISREVFTKQGQFYNETIYPAKPNTAKMIPLKDNKPSEVYGGYSSSNVSKIALIKEKNTDNYQFIGIPIRSIAKLKQAKANSKTVYQTELNRVIKSVLASQKTKKQKEFEVILDNVKYNQVVVDQGEKYYLGSPYYKKNAKQLVISPESVKILADKATADLPEQEAHNKLMTVYQEIVDVLNKHFALYDINNVRKKLNDGLIKFSQLPNYDETSKNRFDISKSIKTKYAVIMRILSGIKNQTSEVPELGLKSPLNKMQTKGGIKISPEAKIYYSSPTGIFSHFKQVKNL

SEQ ID NO: 1186 - protein, 1402 aa, Artificial Sequence
  Cas9
MERILGLDLGVSSIGWALVEEDVKNPENNKIIKLGVRVNPLTIDEKTNFEKGKSITTNAGRTSARSARRNLQRFKLRRKKLLEILIHYKIIKNDAVLAETGKNTTFQTQYLRAKAAREKIELDELARVLLLINKKRGYKSSRKVQNDDDGKAIDGLSVAKELYEKNYTPGQYAYDLLKRGKKQIPDFYRSDLQNELDRIWEFQKQYHPDILTDEFKKELEGKGQRATAAIFLNRYKIYTADNKGTREEKKIQAYQWRVEALSQPLDVKEVAYVIAEINNNLNNSSGYLGAISDRSKKLYFNGQTIGEYLFEELSANPHTRLKNQVFYRQDYQDEFEKIWKIQTKFHPELTKELKEQVRDIVIFYQRKLKSQKGLISFCEFESREIEIEENGKRKRKKVGLKVAPKSSPLFQEFKIWQVLNNIEIKNEDERRYLEPEEKELLFNELNCKGNLTSQKCLELLGFKSKDAKLNFKVVEGNRTNEKLYDAFLKILELQGYNVFELLKIKEDKDEAKLSELKASADEIKGMIKEIFNANLINTSILDFNAELEGKDFENQASYQFWHLMYSYEGDNSPSGNEKLYELLEKKFGFKKEHSKILSTIVFSQEYGSLSTKAMRRIYPYIKDNKYSEACLLAGYNHSKHSLTKEELENRKLKEQLEVLPKNSLRNPVVEKILNQMINLVNATISEYGKLDGVRIELARELKKSAQEREDMAKSINEATLLHQKYATILKQEFGVVNPSRNDIIRYKLYMELTVNGYKDLYTNTKIEKENLFTDKYDIDHIIPQSRFFDDSFSNKVLVPRQSNLDKGNLTAYDFMSNKGSEREEHFLNVIKELLDKGSISKAKYEKLKKKGLEIGDGFIERDLRDTQYIAKKAKEILFEITNSVVTTSGRITDKLRKDWDLVNIMKELNLDNYRRLGLTEIVRNSKGEEKELIPDWTKRNDHRHHAMDALTVAFTTRNHIQYLNYLNARKDEKHKEHQNIYAIENIITEVIEKKNGSKTRRFKAPMNSFRHEAKQHLKEILVSHKTKNKVVTSNINKTKKKGGIHKKTELTPRGQLHKETVYGSKKFLQSREEKVSAKFDYETILMVVNPIHRNALLNRLKEYGNDPKKAFSGKNAINKNPVYLDDSKTDILSEKVTLSWYETGYTIRKSVTPDNFKDYKNLEKITDLGIKKILKERLDQFKGNAKEAFSNLDKDPIWLNEEKGIAIKTVTITGVSNAESLHFKKDHLGKEILDENGNKIPGDFVSTGNNHHLAIYLDEEEKLDDKMVTFYEAVLRVNQGLPVIDKDYNKEKGYKFLMTLKQNEMFVFPNEDFDPNEIDLLDERNLERISKHLFRVQKISKVGYGNSFVRDFVFRHHLETTVEERKELRNITYIQLKSLEGLRNIIKVRLNHLGKIVQIGEY

SEQ ID NO: 1187 - protein, 1404 aa, Artificial Sequence
  Cas9
MTKNILGLDLGVSSIGWALVQEDSKNPENNRIVKLGVRVNPLTVDEQINFEKGKPITTNASRTLARSARRNLQRFKFRRANLIDVLKKCNILKQGDLLTEIGKNSTFQTQELRAKSAKEKVELSDFVRVLLLMNKKRGYRSSRKAKNEDEGQIIDGMSVAKKLYEENLTPGEYSYQLLIENKKQLPDFYRSDLQSEFDRVWKFQKQFNPEILTDDLYKELQGKNKNATWAVLKEPFSLVGIKQIGTIQEKKAEKYFWRSEAVKRQLDFESLAVVFQEINSNLNNSSGYLGAISDRSKELYFNNQTVGEYLFQQLKENSHTKLKNQVFYRQDYLDEFEKIWETQSKYYKELTKELKEEIRDIIIFYQRKLKSQKGLISICEFENREIEITENGKIKKKTVGLKVAPKSSPLFQEFKIWQVLNNLVFQSIESKELFPLDLDIKESIFNEVNIKGNLSAKNVLDLMGYSGKEWKTNFKNIEGNRTNENLYTAFLKIIASEGIEFPKEFKLSIDDDIKVSKIDISSEKIKEFIKENFLKLGINTSILDFNPELDGKDFEKQESYQLWHLLYSYEGDDSASGNVKLYELLEKKFGFKKEHSKILADVGFSPDYGSLSSKAMRKIYPYIKENKYSDACHLAGYNHSKNSFTKDQLANRILKEQLEILPKNALRNPVVEKILNQMINLVNEVIKAYGKPDEIRIELARELKKNAEERANMTSDISKATLLHQKYAEVLQKEFGIKAPSRNDIIRYKLYLELEKNLFKDLYTDVQIKREELFTDKYDIDHIIPQSRFFDDSFSNKVLVPRGANLKKGNFTALDYMEIEGKEKLEKFLNIIKELFDKGAISKAKFEKLQKKGSEIGEGFIERDLRDTQYIAKKAKEILFGITNSVISTSGRITDKLREDWNLVNTMKELNLEKYRKLGLTELIVNSKGEEKERIIDWTKRNDHRHHAMDALTVAFTTHNHIQYLNYLNARKDEKHKEHQNIFAIENTITEIVEKKNGSKERRFKLPIKNFRTEAKKQLEEVLISHKAKNKVVTKNINKIKKKGSIIAKTELTPRGQLHKETIYGSSKFLKTKEEKISGKFDLEMIQKVQNEKYRNALLKRLQEFGGDSKKAFTGKNVISKNPIFLNAEKTEQLPETVTLAWYETGYTIRKVVNPDNFKDFKNIEKVIDKGVRDILTERLKEFNGNSKEAFSNLEKNPIWLNKSKGISIKTVTITGINNAEALHYKKDHLGKEILDENGQRIAVDFVSTGNNHHVAIYEDDNGNLQEKVVSFYEAVERVNQNLPIINKEYNFELGWKFLFTMKQNEMFLFPSDDFDPKEVDLFDDKYLSLISKNLFRVQSISIVQYGNSVIRDFKFRHHLETSVSDEKKLQGVTYQQIKSLQPLKDIIKIRLNNLGKIVQIGEY

SEQ ID NO: 1188 - protein, 1404 aa, Artificial Sequence
  Cas9
MKGNIEKKKQEFNDYYLGFDIGTNSVGWAVSDLSYNLLRFNKKDMWGARLFDEAKTAKDRRVKRNSRRRLERRSKRLKYLEEIFETEICKIDKNFFRRLEESTLHNEDKTFDFRFPIFNDENYTDKEYYKDFPTVYHLRNELIKNENKKFDIRLIYLAIHNILKYRGHFIFEGQDFDSVTDFKEVFSELSAYLSENLEENLDINLCDNIKDIICSKENKTSKGKSFVSLIDSKVIQSVLRCCIGYRVKFKDIFINYEEKEKNEGINLSEIEYDEKRDEIALSLGENILLIDICKKVYDFMILNNILKGNKYISESKVNLYDEHKCDLCNLKYIFKKYLPKKDYFEFFRNENKEKNYVSYISSSLNNGKKKNTCTQEDLNKEIKEYIAKIKEYEENDAVLEKINLKLNENKLLPKLKTNDNGVIPYQIHKIELEKILQNQSKYYDFLLEKIDGITNIERIEKLFTFRIPYYIGTLKGKFSWAKLKENKKITPWNFEKIVDMEESAKAFIERMSNRCSYLKTENVLPKNSLLYSEYELLNELNKVKIKNEFINVVLKNEIIDELFKTTSKVTKKKFVDYLKTKQIFVEKEDISGLDNEFKSKLDSYIKFKKVIGDKIDTLRGYNFVEKCIEFKCFYGDDKKLFKNAINNTEFKDYVSDDELKKINKMKFNKWGRLSKRLLTEICFENVIESESFENIIVALRSTNYNFMEFTSKKFNLSEKVAEENQENTLEKFNINEYVDELYVSPSVKRSIIQTYKIAMEIKKITGKNPKKIFIEMARGGGEKGKKTEKRKERIKTLYANMKDSNEEFLNNLDNLKLSVDNYDDNRLREKKLFLYFMQLGKSMYTGKNIDLNELLFANTYDIDHIIPQSKLKDDSFDNIVLVEKTINKDKDNRDYLDESIRLRMNKFWNFLREKGFITIEKYNRLRRNTYFSDDELSGFISRQLVTTRQSTLEVKKLFEFIFQNTDVVCSKANLVSDFREKYGIIKVRDLNDAHHAQDAYLNIVVGNVFDTKFTKNYWKFIEDRRKVDNIRETYNFKKIFDYDVSRGENVAWLKDYSINTISEMINKKTANITQMITEGKGQLFDLTILKKSKIDKKLTVIPNTPKILKSSLKDSCKIAEKYGYFSTLMPAYFVVFKYIDKNKEVFGFDRIFIFDREKINSNEDIEKYLEDKGYNSPKFIRKVNLKQKILLNGYPYRIVGFTDNKLEIKNSKQFYSDGEHLKYIKHLSAFYNNNNNVKNGEYRINFLKKTSENDRNETTDEAKERLNIEFIKLYEYFCERLNSKIYANYYNSKKYDELIEVFDCFKNLNLLDKAKLLLEFLKIFKKDTYGNFKLLEKPELDKNGKQKLDKNGNLSFEGLSMAFGKLNGKKFKQLVEKDIQFVDESVTGLFEKKEGLEKWQDGEQ

SEQ ID NO: 1189 - protein, 1404 aa, Artificial Sequence
  Cas9
MAKKILGLDLGVSSIGWAIVEEDAENVMNNKIVKLGVRVNPLTVDEQINFEKGKPITTNAGRTLVRGARRNLQRFKLRRLHLIDILQKRNILKQADLLAESGRNSTFQTQEIRAKSAKQKVELSELARVLLLINKKRGYKSSRKAKNEDEGQIVDGMSVAKKLYEENTTPGEYSYELLKSGKKQLSDFYRSDLQAEFDRVWNFQKQFYPEIFSDNLYKELQGKNKNATWKILEIPFSLVGIKQVGTTQEKKIEKYFWRSEAVKKQLDFESLAVVFQEINSNLNNSSGYLGAISDRSKELYFNNQTVGEYLHCQLKENPHTKLKNQVFYRQDYLDEFEKIWEIQSKYHTVLTKELKEEIRDVIIFYQRKLKSQKGLISICEFENREIEITENGKIKKKEVGLKVAPKSSLLFQEFKIWQVLNNLQFQNIESKEIFPLDLDCKESIFNEVNIKGRISAKAVLDVLGYSGKEWKTNFKDIEGNNSNENLYNAYLKIIANEGIEFPKEFKCNLDDDINVSKIICSAGKIIEFVREKFSELGINTSILDFNSELEGTNFEKQKSYQLWHLLYSYDGDDSPSGNQKLYELLEKKFGFKKEHSIILADIGFPQEYGSLSTKAMRKIIPHLKTGLPFAKKSDNDTILSATAMAGYNHSKSLTTEELTKRVLKEHLEILPKNSLRNPVVEKILNQMINVVNEVIKEYGKPDEIRIELARELKKNAEERANMTSEIGKATIQHQKYSEILQKEFGIKSPSRNDIIRYKLYLELSNNGFKDLYTDIQIKREELFTDKYDIDHIIPQSRFFDDSFSNKVLVPRGANLKKGNLTAFDYLESEGKDTLEKFINTITEFYDKGIITKAKYEKLQKKGTEIGDGFIERDLRDTQYIAKKAKEILFGITNSVVSTSGRITDKLREDWNLVNTMKEMNLEKYRKRGLTETVINSKGEEKEKIIDWSKRNDHRHHAMDALTVAFTTHNHIQYLNYLNARKNEDHKQHKVISNIENLITKVFEKKNGSKQRRFLEPIHNFRIDAKKHLEEILISHKAKNKVVTKNINKIKKKGSIIAKIELTPRGQLHKETIYGSSKYLKTKDEKLSGKFDLETINKVQNERYKNALLERLKVFGYDSKKAFTGKNILAKNPIFLNIEKTEQLPEVLTLAWYETIYTIRKSINSDNFKDYKNIDKVTDKKVHNILTDRLREFNGNSKEAFSDLEKNPIWLNKPKGIAIKTVTITGVNNVEALHYKKDHFGKEFLDEKGHKIPVDFVSTGNNHHVAIYEDTAGNLQERVLSFYEAVERVNQGLSVIDKEYNSSLGWKFLFTMKQNEMFLFHSEDFNPQEIDLYDEKNLRLISKNLFRVQKFTVKDYFFRHHLETNVEDNSKLKGDTWKREGLNGIRGILKVRLNHLGKIVQVGEY

SEQ ID NO: 1190 - protein, 1404 aa, Artificial Sequence
  Cas9
MSKKILGLDLGTTSIGWAFVREAEDFQEESSIERIGVRVNPLTTDEQINFEKGKPISVNADRTLKRGARRNLQRYKQRRTNLIQLLKQYKIINENTILAEDDKNTTHSTYALRAKAVSEKISKEAFARVLLMINKKRGYKSSRKAKNEDEGQAIDGMSVAKRLYEEDITPGQLCLQLLKEGKKKLPDFYLSDLQAELEKIWNFQKKFYPEILTDEFKKEIEGKGQRATSASFWAKYKFNTAENKGSRDEKKMQAWEWRSKAINTQLTREEVAYVITEINNNINNSSGYLGAISDRSKELYFNKETVGEYLFRQLRYSPHTRVKNQVFYRQDYLDEFETIWENQSRYHNELTNELKSEIRDVVIFYQRKLKSQKGLISFCEFESKQIEIQKDGKIVKKIIGLKVSPKSSPLFQEFKIWQILQNLEFTNKETKEKKVPDFEAKNLLFEELNIKGNLKGEKAIEILGYKPKEWLVNYKELDGNRTNQVLYEGYLKILEVEGYDIKDLLKIKSNKDEVNLSELSKPVSEIKDLIKSIFESLNINTAILDFNPELEGKDFERQASYQLWHLLYSYEGDNSNTGNDELYRLLYQKFGFGKEHAQILANLSFSQDYGSLSAKAMRKIYPFIKENSYSEACSLAGYNHSSSITKEENDKRELKEKLELLPKNSLRNPVVEKILNQMVNVINAIIADPSMGRPDEIRIELARELKKNAAERAEMTIHINKAKSEHDNYRKILTTEFGIPNPTRNDIIRYKLYEELKVNGYKTLYSNTYIPREKLFSKEFDVEHIIPKALLFDDSFSNKTICARQENLDKGNKTAFDFIQSFYGKEKFEEYLQRIESLAKIKEGDTFVISKAKYKKLLLPEIEIGEGFIERDLRNSQYIAKKAKSMLLDICKTVVPTTGSITDRLREDWGLINIMQELNFEKYKKLGLIEMVEKKDGSFKERITDWTKRNDHRHHAMDALTVAFTKHNHIQYLNYLNARKNENHKMHGNVIAIEQKETELLVDSVGKRKRKFKLPISNFREVAKMHLENILVSYKAKNKVATKNKNRFKTKNGEKVKIELTPRGQLHKETVYGKMKKYETKEEIIGSKFDEATILKVANLEQRNALLQRLKENNNDPKKAFSGKNSLKSNPLYYGVDSKPIPERIKIVWLEDDYTIRKEITPDLKIDKVIDIGIRRILENRLAEFNGNAKEAFSNLEKNPIWLNEGKRIAIKRVTISGVKNAETLHYKKDHLGHEMLDKQGKRIPVDFVSTGNNHHVAIYKDDKSDLQEKVVSFYEAVERINQELPIIDKSFNHDLGWQFLFTMKQNEYFVFPRDGFDPYEIDLLNPDNYKIISPNLFRVQKIATKNYVFNHHLETKAVDGELLKTKKDLSDITYRFIQTPVNLKNIIKVRINHIGQIVKIGEY

SEQ ID NO: 1191 - protein, 1405 aa, Artificial Sequence
  Cas9
MKTILGLDLGTNSIGWALVKEAENSNEKSEIIKLGVRVNPLTVDEKTNFEAGRPLSTNADRTAKRSARRNLQRYKLRRKNLIDLLIKNQLIDKDTPLTEIGKNTTHQTLELRAKAARERIELEDLARVFLAINKKRGYRSSRKVNNEEEGQAVDGMAVAKKLYDENLTPGQYAYELLSKGKKYVPDFYRSDLQAEFNAIWEYQKQFYADILDDELYNALKGQGQQNSRKRFLAIKGVYTAENKGKRDDVKLRHYKWRSEAISKKINIEEVAYVLVEINNDLNKSSGYLGAISDRSKELYFNKETVGENLWKQIQKNPHTSLKNQVFYRQDYLDEFEQIWETQAQFHPQLTLALKEQIRDVIIFYQRKLKSQKGLLSFCQFESWEIERKDENGNVILNKTTQLPKRQTVGRRVAPKSSPLFQEFKIWQNINNLEVTKISEGASKNKKETETLSDDERKLLFEELNLRGNLSQKEVLQILGLKDKEYKTNFSEGLEGNRTNAALFNIYQQIAENEGYGFDWSKKSAQEIKEELKAVFPQIGIQADILDFNANLDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRELLDKLELLPKNSLRNPVVEKILNQMVNVVNQVIETYGKPDEVRIELARELKKSAEKRAEMTKSINEATRRNEDIKKLITKDFGIPNPTKSDVVRYRLWEELAPLAYKDVFTGKQIKKEDLFSSKIDIEHIIPKALLFDDSFSNKTLVFRETNLKKADRTAYDFIESDYNATLDDYIQRVETLYNNTKGTISKGKRNKLLMAQKNLPDGFIERDLRNSQYIAKKAKAMLYQVFKDVNVTSGSITDRLREDWDLINVMKELNFPKYKALGLTEIEERYDIGQEKTKRVEVITDWTKRNDHRHHAMNALTVAFTTSSHIQYLNYLNARKNESHKEHKNIKGIENKITHKQKDKRKFIPPMPNFREEAKKHIETILVSIKNKNKVYTKNINKTKKKSGHNTKEQLTPRGQLHKETVYGKSKRPMSKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKKKGICIKRVTITGVSNAEALHHQKDHLGREILDDNGNPIPADFVSTGNNHHLAVYLDSEGKLQDNIVSFYEAVVRTSQGLPVVDKGLNKDLGWKFLFSLKQNEMFVFPNDDFDINDFDLLDDKKAELISKHLYRVQKISKVSAGNSFVRDIVFRHHLETTVKEVKELKDISYIQLKSLEGLRNIKKVRINHIGKIVQVGEY

SEQ ID NO: 1192 - protein, 1406 aa, Artificial Sequence
  Cas9
MEKKIIGIDLGVTSIGWAYVIEDENGHSRILRIGTRVNPLTTEELKNFEQGKPITETAERTLKRSMRRNLQRYKQRRTNLINVLLKNKLITETTALAEDGKGTTHLTHALRAKAAYAQIPLEDFARVLLMLNKKRGYRSSRKVKTEADGQAIDGMAVAKKLYEENITPGQLCYTLLLQGKKTLPDFYRSDLQVEMEKVWTFQKQFHQAILTDEFRKYIAGKGQRATAASFWGKYGFNTAEFKGSREEKKLKSYEWRSQAITTPLSQEEVAAVITDINSNIANSSGYLGAISDRSKELFFNKQTVGQYQYNLLQQNPHTNLSGQVFYRQDYLDEFETIWETQATFHTMLTPSLKEEIRDIVIFYQRKLKSQKKLVSICEFEKRILEPLQGDKVVGYKVAPKSSPLFQEFKIWQALGRMEIQHKVTKERHFLDLDAKQLLFDELNVKGDLTKENALTILGFKPKEWECNLLKLEGNRTNQALYEAYLKILELEGYEVKDLLGLKLDKDDIKLSELPVDAADIKKMVREIFETLNIKTSLLDFNATLPGKSFEQQHAYQLWHLLYSYEGDNSPSGNKKLQDLLQAKFGFTNAHGQILANVSLETDYGSLSAKAIRKIFTHIKENHYSAACALAGYNHSSYLSKEENEQRILKDRLTILPKNSLRNPVVEKILNQLINLLNTIFDDPYLGKPDEIRIELARELKKNVQERQRLNTEITKNNTEHERITKILIKEDNIKNPTRNDIIRYKLYQELKHNGYKTLYSNTYIPREELFGKNFDIEHIIPQSILFDDSFSNKTLCVRKENIDKADRTAMDFIGPYFGEDKVQEYINRVEMLHQINLKNPEEGIGKGKYKKLLMKASEIGQGFIERDLRDTQYIAKKARQMLLEVTRTVVATTGSITKRLREDWGLVNVMQELNMDKYRQQGLTELIEKKDGSTKERITDWTKRNDHRHHAMDALTIAFTKHSHIQYLNNLNARKSDDKKGKEIFGIEQKETEKVKDDTGQTQRRFKLPMPDFRQAAKHHLEHLLISFKAKNKVFTKNKNKYKTKNGEQVKLELTPRGQLHKETIYGRIKKYVTHEEKVSSKFNAQLIQTVANSKYRYALLKRLEENGNDPKKAFTGKNSLDKTPLFVDATQQEKIPPVVKLVSIEQGYTIRKDITPENFKDAKSIEKIVDVGIRNLLHHRLETYNGNEKEAFYNLDKNPIWVNESKGICIKRVTITGVTNAEPLHYKRDHHGKPILDNNGNRTPADFVSTGNNHHAAIYRDAAGNLQDNVVSFYEAVARVNQGLPIIDKSLNKELGWQFLFSLKQNECFVFPNEGFDPLEIDLYNPANNKLIAANLFRVQNFSRLQYGNNIIRDYNFRHIYETSVENRKELKDIAYKQVKSLPIFEKIIKVRINHIGQIVKTGEY

SEQ ID NO: 1193 - protein, 1407 aa, Artificial Sequence
  Cas9
MIRNILGLDLGVSSIGWAYVQEDSKNSENNRIIKLGVRVNPLTVDEQLNFEKGKPITTNAGRTLARSARRNLQRFKLRRSNLMDVLKKNNILKETDLLAEVGKNSTFQTQELRAKSAKEKIELSEFARVLLLINKKRGYKSSRKAKNDEDGQIVDGMAVAKKLFEENLTPGEYSYQLLQQGKKQLPDFYRSDLQAEFDKIWDFQKQFNPEIFTNELYEKLQGKNRNATWKELEFPFSLVGIKQTGTMQEKKVEKYFWRSEAVKKQLDFESLAVVFQEINSNLNNSSGYLGAISDRSKELYFYNQTVGEYLFQQLKTNPHTKLKNQVFYRQDYLDEFEKIWETQSKYHKELTKELKEEIRDITIFYQRKLKSQKGLISICEFENREIEITENGKTKKKTVGLKVAPKSSPLFQEFKIWQVLNNLQFQNIETKEVFPIDLDFKQSIFDEVNIKGKLSAKDVLDLVGYSGKEWKTNFKEIEGNYTNENLYTAFLKIIASKEIEFPKEFKITIDDEIKVSKINASAEIIKLFVREKFSELGIDTSILDFNPELEGSDFEKQASYQLWHLLYSYEGDDSSSGNEKLYELLENKFGFKKENSKILAEIGFSQDYGSLSSKAMRKIYPYIKEHKYSVACSYAGYNHSKNSLTKEQLENRILKERLDILPKNSLRNPVVEKILNQMINLVNCLIDEYSEKDKDGQIVKYFKFDEIRIELARELKLNAEERATMTSEINKATIQHQKYAEVLQREFGLKAPSRNDIIRYKLYLELANNGFKDLYTDAKIERENLFTDKYDIDHIIPQSRFFDDSFSNKVLVPRNANLKKGNFTAFDYLEIEGKEKLEKFLNIIKDLYDKGAITKAKYEKLQKKDFEIGDGFIERDLRNTQYIAKKSKEILFGITNSVVTTSGRITDKLREDWNLINTMKELNLEKYRKLGLTETVINSKGEEKQRIIDWTKRNDHRHHAMDALTVAFTTHNHIQYLNYLNARKDEKHKEHQNIFAIENLITEIIDKKNGSKERRFKEPVKNLRAEARKHLDEILISHKVKNKVVTKNINKIKKKGSVIAKTELTPRGQLHKETIYGSSKFLKTKEEKISGKFDVETIQKVQNERYRNALLKRLQEFGGDSKKAFTGKNVISKNPIFLNNEKTEQLPETVTLAWYEMGYTIRKAVNPDNFKDFKNIEKTIDKGIRDILTKRLKEFNGNSKEAFSDLDKNPIWLNKSKGISIKAVTITGINNAEALHYKKDHLGKDFLDENGKRIAVDFVSTGNNHHVAIYEDENGNLQEKVVSFYEAVERVNQNLPIIDKEYNSESGWKFLFTMKQNEMFLFPSEDFNPKEMDLFDEKNVNLISKNLFRVQKFTIKDYFFRHHLETNVEDSSPLKGITWKREGLNGIENILKVRLNHLGKIVQIGEY

SEQ ID NO: 1194 - protein, 1408 aa, Artificial Sequence
  Cas9
MTKNILGLDVGVSSIGWALINEDIENPKNNKIIKLGVRVNPLTVDEQINFEKGKPITTNAGRTLARGARRNLQRFKLRRFHLIDILQKNNILKQADLLAEVGKNSTFQTQEIRAKSAKQKVELSELARIFLLINKKRGYKSSRKAKNEDEGQIIDGMFIAKKLYDEKLTPGEYSYQLLKESKKQLPDFYRSDLQSEFDKIWNFQKQFYPENFSDNLYKELQGKNKNATWKTLEIPFSLVGIKQTGTLQEKKLEKYSWRSDAVKKQLDYEKLAVVFQEINSNIYNSSGYLGAISDRSKELYFNNQTVGEYLYNQIKENPHTKLKNQVFYRQDYLDEFEKIWETQSKYHTTLTKELKEEIRDIIIFYQRKLKSQKGLISICEFENREIEIKENGKIKKKTVGLKVAPKSSPLFQEFKIWQILNNLQFQNIESKEIFPIDLDFKESIFNEVNIKGRISAKAVLDLLGYSGKEWNPNFKDIEGNNTNENLYNAYLKIIADEEFELPKEFKLNGDDDLYVSKIACSASKIKDFVKEKFSEIGINTSILDFNPELEGKDFEKQASYQFWHLLYSYEGDDSQSGNEKLYELLEKKFGFKKEHSKILSNIGFPLDYGNLSTKAMRKIIPHLKAGLSFAKKSKEDNILSATAMAGYNHSNSYTKEDLAKRVLKEKLEVFPKNSLRNPVVEKILNQMINLVNEAVEEYGTIDEVRIELARELKKNAEERANMTSEIGKATLLHQKYAEILKKEFDIPVPSRNDIIRYKLYLELANNGYKDLYTDVQIKREELFTNKYDIDHIIPQSRFFDDSFSNKVLVPRGANLKKANQTAFDYLENEDKQKLEKFLNIIKNLYDKGEITKAKYEKLQKKGSDIGEGFIERDLRDTQYIAKKAKEILFGITHSVISTSGKITDKLREDWNLVNTMKELNLDKYKKLGLTETLLNSKGEEKERIIDWSKRNDHRHHAMDALTVAFTTHNHIQYLNYLNARKDEDHKQHKVISNIENLITKVFEKKNGAKQRRFIEPINNFRVDAKKHLDEILISHKAKNKVVTKNINKIKKKGSVVAKTELTPRGQLHKETIYGSSKFLKTKDEKISGKFDLETINKVQNEKYKNALLQRLREFGEDSKKAFTGKNVISKNPIYLDEEKTLQIPESVTLAWYEMIYTIRKPVNPDNFKDYKNIDKVTDEKIRAVLTDRLRKFNGNSKEAFSDLEKNPIWLNKSKGIAIKTVTITGMSNVEALHYKKDHLGKEILDKKGDRMPVDFVSTGNNHHAAIYEDAKGNLQERVVSFYEAVERVNQGLSVVNKDYNAGLGWKFLFTMKQNEMFLFPSEDFNPKEIDLYDEKNLKLIAKNLFRVQKFGELSKSGFWFRHHLETSVDVKKELRNYSYLDFYSKDFMKTIVKVRLNHLGKIVQVGEY

SEQ ID NO: 1195 - protein, 1409 aa, Artificial Sequence
  Cas9
MSIINFQRRGLMETQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYTDQDYYKAYPTIYHLRAELMKDGTDDIRKLFLAVHHILKYRGNFLYEGATFDSNASTLDDVIKQALENITFNCFDCNSAISSIGQILMEAGKTKSDKAKAIEHLVDTYIATDTVDTSSKTQKDQVKEDKKRLKAFANLVLGLNASLIDLFGSVEELEEDLKKLQITGDTYDDKRDELAKAWSDEIYIIDDCKSVYDAIILLSIKEPGLTISESKVKAFNKHKDDLAILKSLLKSDRSIYNTMFKVDEKGLHNYVHYIKQGRTEETSCNREDFYKYTKKVVEGLPDSKDKEYILSEIELQTLLPLQRIKDNGVIPYQLHLEELKVILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKAVKEHLIEAVFKQDHKKMTKNRIEQFLKDNNYIPEKHKPEITGLDGEIKNDLASYRDMVRILGNNFDLSMAEEIITDITIFGESKKMLRETLRNKFSSRLDDEAIKKLSKLRYRDWGRLSRKLLNVIEGCDKAGDGTPETIIILMRNFSYNLMELLGDKFSFMERIQEINAKLIEGQIVNPHDIIDDLALSPAVKRAVWQALRIVDEIVHIKKTLPARIFVEVTRSNKAEKKKKDSRQKRLSDLYAAIKKDDALLSGLTNEEFGGLKSGLAKYDDAALRSKKLYLYYTQMGRCAYTGEVIDLSQLNTDNYDIDHIYPRSLTKDDSFDNLVLCKRTANAQKSDTYPISKEIQKAQKAFWIFLKQQGLISERKYERLTRITPLTADDLSGFIARQLVETNQSVKAATTLLRRLYPGVDVVFVKAENVTDFRHDNDFIKVRSLNHHHHAKDAYLNIVVGNVYHERFTRNFRAFFKKNGANRTYNLAKMFNYDVNCTNAKDGKAWDVKTSMDTVKKMMASNDVRVTKRLLEQSGALADATVYKAAVAEKAKDGAYIGMKTKSSVFADVSKYGGMTKIKNAYSIIVQYAGKKGEVVKEIVPLPIYLTNRNTTDQDLIDYVASIIPQAKDISIIYRKLCINQLVKVNGFYYYLGGKTNSKFCIDNAIQVIVSNEWIPYLKVLEKFNNMRKDNKDLKANVISTRALDNKHTIEVRIVEEKNIEFFDYLVSKLKMPIYQKMKGNKAAELSEKGYGLFKKMSLEEQSIHLIELLNLLTNQKTTFEVKPLGITASRSTVGSKISNQDEFKVINESITGLYSNEVTIV

SEQ ID NO: 1196 - protein, 1410 aa, Artificial Sequence
  Cas9
MTKNILGLDLGVSSIGWALVQENSKNPENNKIVKLGVRVNPLTVDEQINFEKGKPITTNASRTLARSARRNLQRFKLRRANLIDVLKKGNILKQGDLLTEIGKNSTFQTQELRAKSAKEKVELSDFVRILLLINKKRGYKSSRKAKNEDEGQIIDGMAVAKKLYEENITPGEYSYKLLQEGRKQLPDFYRSDLQAEFDKIWNFQKQFNPEIFTNELYKRLQGKNRNATWKELEIPFYLVGIKQIGTMQEKKIERYFWRSEAVKKQLDFESLAVVFQEINSNLNNSSGYLGAISDRSKELYFNNQTVGEYLYNQLKINPHTKLKNQVFYRQDYLDEFEKIWETQAKYHKKLTKELKEEIRDIVIFYQRKLKSQKGLISFCEFENREIEITVNGKTKKKTVGLKVVPRSSPLFQEFKIWQRLNDLEFKNVETKEIFPLELEHKEILFGNLNIKGNLSSKELIEQLGYPSKEWKCNFKEIDGNKTHENLYTAFLKIIANEGIEFPKEFKLSIDDDIKVSKIDVSSEKIKEFIKENFLKLGINTSILDFNPELDGKDFEKQESYQLWHLLYSYEGDDSASGNEKLYELLEKKFGFKREYSKILADVGFSQDYGSLSSKAMRKIFTYIKENKYSEACHLAGYNHSKNSLTKEQLANRILKEQLEILPKNALRNPVVEKILNQMINLVNEVIKEYGKPDEIRIELARELKKNAEERANMTSDISKATLLHQKYAEVLQKEFGIKAPSRNDIIRYKLYLELANNGYKDLYTNQKIEKENIFTDKYDIDHIIPQSRFFDDSFSNKVLVPRCANQDKDNYTAVDYIEKKYGERGKEDFLNRIHLVFKSKEAIAGKSESQISSMNTKFLKLQKKGSEIGEGFIERDLRDTQYIAKKAKEILFGITNSVISTSGRITDKLREDWNLVNTMKELNLEKYRKLGLTELIANSKGEEKERIIDWTKRNDHRHHAMDALTVAFTTHNHIQYLNYLNARKDEKHKEHHNIFAIENIITEIVEKKNGSKERRFKLPIKNFRTEAKKQLEEVLISHKAKNKVVTKNINKTKKKGGVVSKIVLTPRGQLHKETIYGSAKFLKTKEEKISGKFDLETINKVQNEKFKNALLDRLKEFNGDSKKAFTGKNVPAKNPIYLNEQKTEQVPESVVLAWYETGYTIRKAVNADNFKDYKNLEKIIDKGVKEILKNRLNAFNGNAKEAFSDLEKKPIWLNQSKGIAVKTVTITGINNAETLHYKKDHFGNELLDENGKKIPVDFVSTGNNHHVAIYEDADGNLQERVVSFYEAVERVNQGLSIIDKEYNQDLGWKFLFTMKQNEMFLFPSEDFNPKETDLFDEKNLNLISKNMFRVQKFGSLLSGFWFRHHLETTVDLNSSLKDTSYKVIQSCNNLKLIVKVRLNHLGKIVQIGEY

SEQ ID NO: 1197 - protein, 1411 aa, Artificial Sequence
  Cas9
MVKKEYFIGLDMGTSSVGWAVADTNYNLLRAKGKDMWGVRLFPEASTAADRRSHRTARRNNKRKAAREGFLREIFEDEINKIDPGFFERLKESKYYLEDKLTDTPFVLFADKGYTDKEYYDEYPTVFHLIKELISEKGLEPHDIRLVYLACLNIYKHRGHFLNDTLSGDGIDNINSLCNDFTSYLADYNQNSEDDGTEKMDLDSTVLAGVFEETLCNKHLSNSAKKRDLIDKLGITNKTKYLTEMMALISGLASSVSNMFAKDTYDEEQKKFKLSFRSSNLDEDMVKVQAMLTPEEYEMICIMKKIHDWSVVSVIMGSHKYISDARVELYEKHKQDLAKLKAIYKEYLPDKYDAMFREMTDNSYSAYVGKVSSNKKSQTGNHKVRMQRRGAKCKQEDFYDRIKKEINSVPQEEKIDILQDMETNSFLPKQLTNENGVIPYQLHLAELKKILDNASTYLPFLNSADETGISNKDKIIQLFEFRIPYYVGPLFKSEKNKTNAWVVRKESGKVYPWNFNEKIDEKQSAEIFIERMVRHCTYLNNESALPKNSLKYERFRVLNELNNLRINGERISPELKQRIYNELFKVKKKRITKSMLCEYLYKNGIADKDSELSGFDGTFANALLSYGKFRELFNVDTLTDKQEAAAEDIIKWSTVYGDSKKFLQEKIEENYGPESENPLLDNKQIKRVMGYKFTDWGNLSREFLNLEGADKDNDTTTGEVMPLITRMWEENYNLMELMSNKFSYRDALAEKTEEIEKTLTDIEYEDLEDLYISAPVKRMTWQTLLILKEIYQIMGYAPKKIFVEMAREEEEKVNGKGARKSSRKKRLEDLYRNCKDASKELSTGIKNADEAILRRKKLYLYYLQKGKCMYSGKTIDFKSLFTNNYDIDHIYPQSVVKDDSLENNMVLVERNYNNKKSDTFPIFSDWQNKMKPFWTMLKEQGFINEEKYKRLTRTDELTDDELANFVNRQLVETRQATKVIAELLKNSFDDIDSKIVYAKAGNVSEFRHKFSMKYDKETEKSSVIHPELVKCRIINDFHHANDSYLNIVVGNIYDVKFTQNPYNYIKEYKKQKNNSALSEQEKEKYHMDKIFNFDVKRNGEVAWISRGDNKTLETVLKVMRKNTPIVTRMNFEEHGQLADLTIYSASDALSKKGVGYIKVKASDARLDVLKYGGYKKYKGAYFFLVEHTEKNKRVRTIENMPLYLKNELNTKEKIELWCADKENGLGLVDPDVRLGKIKLYSKIRIDGFDLYLTGRTGNNLLTSNAVQLKIGSNKPSDNDKLFWRYYINKLSKYTENSEFVSIQNNIKLYDLFVEINNAGVYSKRQNPIGDKLLEGRSKFINLTLSKQVETLLGIIRIYSLENQGADLSNIGGQEKNGTMKPHKRISDKKEVLLINQSVTGLYESKIDLLKI

SEQ ID NO: 1198 - protein, 1411 aa, Artificial Sequence
  Cas9
MKNILGLDLGTNSIGWALIKQNAEERQGSILGMGTRVLPMSQDVLGDFGKGNSVSQTAARTGYRGIRRLRERFLLRRERLHRVLNILGFLPYYYAAQIDFDKRFGKFKAETEPKLPYNNEGFIFKNSFEEMLSDFKISQPELLSGNKKVPYDWTIYYLRKKAVSQKIEKEELAWILLNFNQKRGYYQLRGEDFDEEKDKTFVTLNVDKVIDSGEKVKGNILFDIYFTNGWKYEKQTTKPEDWLGRSKEFIITESLLKNGEVRRTFKAVDSEKDWIAIKAKTEQEIETAHKTVGSYIYDAILQNPKQKIKGKLVRTIERKFYKEELRKILEKQKDFHLELQNEDLYSDCVRELYRNNDTHQLSLAKKSFIHLFLEDIIFYQRPLKSQKSSVSNCTLECRKYRDKNGAEGIQFLKVIPKSNPYYQEFRIWQWMSNLKIYRRDDDVNITSECLKTAEDYEDLFVFLNIRKEVDQKACLRHFKLSEKTHRWNYVEDKKYPCNETGTMISERLKKVGDSPDNIFTREMEQQIWHIIYSVNDKTEYEKALKSFAKKNELDNDSFFEAFRKFPPFDSEYGSFSEKAIKKLLPLMRIGKHWNWEAVDEKIKNRIQKIIIGEYDENIKDNIREKTLSLQKESDFQGLPLWLAQYVVYGRHSEASVAGKWNSVDDIEEYLKEFKQHSLRNPIVEQVIMETVRVVKDIWIKYGNGAADFFDEIHIELGREMKLPAKERNKMTQKISENENTNLRIKALLAEMMNDSEVQNVRPYSPMQQEILKIYEDGALNSEISVDDDILKISKTAQPSPSDLKKYKLWLEQKYRSPYTGDIIPLNKLFTTEYEIEHIIPQSRYFDDSFSNKVICESLVNRLKDNYIGLGFIKQFHGYKISDKTKVFEVEEYEDFVKKNYANNRSKRSKLLLEEIPEEMIERQLNDTRYISKYISGILSNIVRKKENDEGVNSKDIIPGNGKITSQLKQDWGLNDVWNDLILPRFERMNELTKSSYFTVWNEKYQKFLPTVPVEFSKGFSKKRIDHRHHALDALVIACATKDHVNLLNNKSAKSEMKRYDLKRKLMKFEKKTYQHSQTGERIVKDVPVEFLKPWNDFTVEAKENLEKIIVSFKQNLRVINKATNHYEKWIEKDNVKVKGLVEQQGLNWAIRKPLHKDTVSGKVDLPGIKVPKGKILTATRKSIDTSFDLKTINSITDTGVQKILKNYLEYKGNSSEEAFSSEGIEDMNNNIEKFNEGKLHQPITKVRIFELGSKFPLGQIGNKKHKYVETAKGTNLFFAIYEDDKGKRTYETIPLNEVIERQKQGLAPVTLKSKNDFYLCPNDLVYVAAEGESVNKIDFKYASQEFIHNIYKVVSFSGSQIFFVKQNIAVSIVNKAEFSTLNKMERAVDGKMIKDCCIKLKIDRIGNITKS

SEQ ID NO: 1199 - protein, 1412 aa, Artificial Sequence
  Cas9
MMTKNILGLDLGTNSIGWALIKQNAEERKGSILGMGTRVLPMSQDALGDFGKGNSVSQTAARTGYRGVRRLRERFLLRRERLHRVLNILGFLPDYYAAQIDFDKRFGKFKAETEPKLPYNNEGFIFKNSFEEMLSDFKISQPELLSENKKIPYDWTIYYLRKKAVSQRIEKEELVWILLNFNQKRGYYQLRGEDFDEEKDKTFVTLNVDKVIDSGEKVKGIVLFDVYFTNGWKYEKQITKPEDWLGRSKEFIITESLLKNGEVKRTFKAVDSEKDWIAIKAKTEQEIEIAHKTVGSYIYDAILQNPKQKIKGKLIRTIERKFYKEELRKILEKQKEFHPELQNEDLYSDCVRELYRNNDAHQLSLAKKDFIHLFVEDIIFYQRPLKSQKSSVSNCTLECRKYKDKNGEERIQFLKVIPKSNPYYQEFRIWQWMSNLKIYRRDDDVNITSEYLKTTEDYQDLFVFLNTRKEVDQKACLKHFKLNEKTHRWNYVEDKRYPCNETGTMILERFKKVGDSADNIFTREMEQQMWHIIYSVNDKTEYEKALKSFAKKNDLDNVSFFEAFRKFPPFDSEYGSFSEKAIKKLLPLIRTGKYWNWEAVDEKTKKRIQKMITGEWDEDIKDNIREKTLSLQKESDFQGLPLWLAQYAVYGRHSEASVAGKWNSVNDMEEYLKEFKQHSLRNPIVEQVITETIRVVKDIWIKYGNGAADFFNEIHIELGREMKLPAKERSKMTQKISENENTNLRIKALLVEMMNDSEVHNVRPYSPMQQEILKIYEDGALNSEISVDDDILKISKTAQPSPSDLKKYKLWLEQKYRSPYTGDIIPLNKLFTTEYEIEHIIPQSRYFDDSFSNKVICESSVNRLKDNYIGLGFIKQFHGYKISDKTKVFEVEEYEDFVKKNYASNWSKRSKLLLEEIPEEMIERQLNDTRYISKYISGILSNIVRKKENDDGVNSKDIIPGNGKITSQLKQDWGLNDVWNDLVLPRFERMNELTKSNDFTVWNEKYQKFLPTVPVEFSKGFSKKRIDHRHHALDALVIACATRDHVNLLNNQSARSEMKRYDLKRKLMKFEKKAYQHSQTGERIVKDVPVEFLKPWDNFIVEAKENLDRIIVSFKQNLRVINKATNHYEKWIEKNNVKVKALVEQQGLNWAIRKPLHKDTVSGKVDLPGTKVPKGKILTATRKSIDTSFDMKTINSITDTGIQKILKNYLEYKGSYEDAFSPEGIEDMNKNIEKFNDGKQHQPIIKVRIFELGSKFPLGQIGNKKHKYVETAKGTNLFFAIYEDDKGKRTYETIPLNEVIERQKQGLAPVTFKSKNDFYLSPNDLVYVAAEGESVDNLDFQSDSQEYINNVYKVVSFSGSQIFFVKQNVAVSIVNKAEFSTLNKMERAIDGRMIKECCVKLKIDRIGNMTKS

SEQ ID NO: 1200 - protein, 1414 aa, Artificial Sequence
  Cas9
MKKILGLDLGTNSIGWAFVEEAENESEKSSIIKLGVRVNPLTVDEQQNFEKGKSITTNADRTLKRSMRRNLQRYKQRRENLIDILMKNGFTSDDTILSENGNRTTFETYRLRSKAVAEKISLQEFARVLLMINKKRGYKSSRKAKGTEDGELIDGMEVAKKLYNYNLTPGQLCLQLLNEGKKHLPDFYRSDLQAEFDRIFDIQMTFYTEYLTLELKEELRGKKRDAVWAICAKIFKEKGFELIGTKRQGSTAEQKHENYSWRAKGLSEKLELEQLVVVLQQINIQLNSSSGYLGAISDRSKELFFNKQTVGQYQMAVLDKNPNAGLRNMVFYRQDYLDEFNAIWEKQALFHPILTDTLKDEIRDVIIFYQRRLKSQKGLISFCELESRKIEVEIAGQNKTKMVGSRVIPRSSPLFQEFKIWQSLNNIEVFGKGKKSKKQKEQTLFDQTEDPLEFGGRRELYEEEKELLALELSIKKELKKADILKLLFDNPKELDLNFNAVQGNLTQATLFNVYKKIIELSGHEIDVEKDSASKILKSIEEIFKALNYNTEILHFDSEKSQDQQAMYMLWHLLYSFEGDNSNTGNENLINKISKLYGFEKEYAKILANVSFQDDYGSLSAKAISKILPYLKEGHKSDIACDLAGYKHSASSLTREELENKTYKDRLEILPKNTLRNPVVEKILNQMINVINLIIDSRELKKSAKEREELTKSISETTKLHQQYKDILAKAPFNLTNTSRNDIIRYKLYEELKDNGYKTLYSNKYISPAALFSGDFDIEHIIPQSRLFDDSFSNKTLELRSINIEKGNKTAYDFIKGKYGETGEDNCLDKYLNRIETLYKNGILKKSKYNKLKMQDKDIPDGFIERDIRDTQYIAKYAKTLLGDLVKFVVSTSGSVTERLREDWQLVDVMKELNWEKYMQLGLTEEFTNEEGHRIRKIKDWTKRNDHRHHAMDALTVAFTKRQFIQYLNNLNARRISDEQGISNSEKDERNNVSITTNDMKLNTRDVLGIEKKELYRDNRGKLRFKAPMPLLEFREEAKRHLENTLISIKAKNKVTTININTLKKAGGVYKKTQLTPRGQLHNETIYGSQKQYIVKEETINAKFDVEKIATVTNPVYREALLKRLEQNNNDPKKAFTGSNALTKKPMWFDEQQTEKVPEKVKTVSFETIYTIRKEISPDLKIEKVVDEKVRQILNNRLNEYNGNAKQAFSNLDENPIWLNKEKGITIKRVTITGINNAQALHEKLDKDGKPILDGEGKKQPVDFVNTGNNHHVAVYCDADGNLQENVISFYEAVTRRNLGLPIIDKDYKKDDGWQFLFSMKQNEYFVFPNESTGFNPNEVDLLNPDNYSLISPNLFRVQKFTIKDYFFRHHLETNVESNSTLKGITWLRCGLNNIDNIIKVRINHIGQIIHVGEY

SEQ ID NO: 1201 - protein, 1415 aa, Artificial Sequence
  Cas9
MAKFNKPYSIGLDIGVSSVGYAVITEDYRVPAFRFKVLGNTEKEKIKKNLIGSTTFVPAQSAQVTRVFRVNRRRIDRRNHRIAYLRDIFQKEIEKVDKNFYRRLDESFRVLGDKSEDLQIKQPFFGDKELETAYHKKYPTIYHLRKHLADADKNSPVADIREVYMALSHILKYRGHFLTLDKINPNNINMQNSWINFIESCQEVFDLEVSEESKTIAAIFKSSENRQEKVKQILSYFQQELLKKDKSIFKQLLQLLFGLKTKFKDCFELEEEPDLNFSKENYDENLENLLGTLEEDFSDVFAKLKILRDTILLSDMLTYTGATHARFSATMVERYEEHRKDLQRFKSFVKQNLSEQDYLDIFGRKTPNGFDVDKETKGYVGYISNKMVLTNKQKTIQQNFYDYISGKITGIEGAEYFLNKISDGTFLRKLRTTDNGAIPNQIHAYELEKIIERQGRDYPFLLENKDKLLSILTFKIPYYVGPLAKGNNSRFAWIKRATSQDILDDNDEDTRNGKIRPWNYHKLINMDKTRDAFITNLIGNDIILLNEKVLPKRSLIYEEVMLQNELTRVKYKDKYGKTHFFDSELRQEIINNLFKTNSKRVSSAMLLNYLENYTNLQAVEIVSGIEKGKSLNSTLKTYNDLKTIFSEELLDSEIYQKELEEIVKVITVFDDKKSIKNYLTKYFGRLEFLNEERINQLSKLRYTGWGRYSAKLLLDIRDEDTGFNLMQFLRNDDENRNLSQLISDSTLSFDSAIKSIQSKSTVEDDVFDEIKKLAGSPAIKRGILNSIKIVDELVQIIGYPPQNIVIEMARENMTTEEGQKKAKTRKTKLESALKNIENSVLENGKVPHSDEQLQSEKLYLYYLQNGKDMYSLDKTGSPTPLYRDRLDQYEVDHIIPYSFLPIDSIDNKVLTHRENNQRKLNNIPDKETVANMKPFWEKLYNAKLISQTKYQRLTTSERTPDGVLTESMKAGFIERQLVETRQIIKHVARILDNRFLDTKIITLKSQLITNFRNTFHIAKIRELNDYHHAHDAYLAVVIGQTLLKAYPKLAPELIYGHHAHFNRHEENKATIRKHLYSNIMRFFNNPNSKVSKDIWNCNRDLPIIKDIIYNSQVNFVKRTMIKKGAFYKQNIIPNDSSVTVDKRFPIKNKKYLDPKLYGGYYERNSALSVFIIGQSFNKNNKLKVVKEFYDINIIDYPLFNTDPMSFFNDDSENGFLTKNNLQSVQAFYKIPKYSLIQKNDGTRMLFESTTNFHKATQFKLTEAQNELFFHMKRLLTKTDFMDLKSEESIKESQDFIMNHKNEFDNIVNGLFGYAERQLGSKSLFTQAHEAYKLRKYPVFSLNEETIRYYYDNFLRLFSLTKSGTSSGYVVGLFEAPKLRNVVYRATKDESNATLIHQSITGLYETRIDLSKLGED

SEQ ID NO: 1202 - protein, 1415 aa, Artificial Sequence
  Cas9
MNLRNVAKEGINYNIGLDLGTGSVGWAVTDEQGELFSFKGKTTWGSRIFPTAETAADTRLKRGQRRRYARRRWRLDLLQSLFEEEIKKVDPEFFTRLRQSHLLKEDKTYAAILSSKGATRPLFPEGEAEVEYYKKYPTIYHLRKALMESNNQEDIRLIYLAFHNIVKARGNFLHQDTPGLTASNANMGDAVEKLCSALEDWCSSQNIECAIRKNQKSIQDLMEGKTIEPSESNALKETFDASRSSRKDKASVLAGWIAIQPGEQFEPKQAKDASKEIANAVFGLSANMKKVFVELEEDQKIYLNNDEQVEAFYTVCPDEGVALFEALQSMYSAYVLMGILKGADGGSISSCKVAAYEQYKEDLKLLKTLVREFAPKKYDEFFRGDIFDAKKGFRTRNYDPATAKGYTKYNSVRGASYDAFKKEVEKLFEGTAAEEDVRYTDMMQRFDEGTFLRRLKTSDNGSIPYQLHLEEMVAIIENQKTFYPFLEENKEKFESLVTFRIPYYVGPLTQKNARPDNHGNARFAWSQRKEGQENARVYPWNWEEVIDRKQSAAKFMERLTGTCTYILEEPVLPRYSLLYEEYCLLNELNGARWRDMGGDWHRFDYETRMDIIEDLFKKKKGTVKYATVADWLVREKHRSCAEVKGGQGETGFESKLSSYVFFKGVLHVDEIDEADIPMIEELIWWNTLFEDRSILKESIEDKYGDRLNDEQIKAICKKRFTGWGRLSKKLLCGIKAQTDNGPCSIMDVLREGNPNNDARSATMVFMEIIRDDKFGFTKLIEEENKKRISSVDDFDVNDLPGSPAVRRTVNQAKRIVDEIVGIAGCAPQNIFIEVTRDEDGRNKGRRTKRRYDAIQEAVKVLKKEQKEYFDANVADLLKNTAPAALDDERLALYFMQNGKCMYCGKDLDINQLDKYQVDHILPQSYVKDDSFENKALVHSDDNQRKSNSMLLDDSIIRKMKPYWEALRSAGLIGEKKFKNLTRVRVSDKELGGFIARQMVETSQSMKLTSLLLEQAYPETQVRPVKAGFSSDLRRRLKLVKCREINDYHHAHDAYLACEVGQFIALRHNKLYENPIGYSHAVKDFIAKRAKYASEHGKPMDTYGMPGSSSFVISSFMTSGFDEETGEIFKDAWDASLAAVRIHQALNRKDCYISRMPEETSGAFWDATIYSPKQTKKKLSLPLKKGLDPQKYGSYSREQFAYFFVYEAKKIKKKEETKEYVFASVPVQVAALVAADPNALIEFAKADAEERGLKFAKIVREKVYKYQLIEVNDERFFVTGLRTVRNGLQIAFSEQDRNIVSGIVEGNSSNNNLLDIYDKITNRYALYASRFGKLLNLSGYRENFIQASLEDQERVVLALISLFNARTNMIDLSAIGSSKTVGNMSMTFAKEMAMADNRFAFIDQSVTGMLERKTYL

SEQ ID NO: 1203 - protein, 1416 aa, Artificial Sequence
  Cas9
MGSRIIPMSQDILGEFGKGNSVSQTSERTAYRSTRRLRERFLLRRERLHRVLNILDFLPTHYASQIDFKKRLGKFKENKEPKIAYDNKSFLFLDSFNEMLKDFEQEQPNMLINEKGEKKLIPYDWTLYYLRKKALREKISKEELSWIILNFNQKRGYYQLRGEDEEENPSKLVEFHSLTVVDVVPDEPIKGKLETWYSIILDNGWVYRRSSKTELYDWKDKIKEFIVTTDLNYDGTVKTDKEGNVKRSFRAPSETDWTLIKKKTEYEIEQSSKTIGEYIYNTLLKYPEQKIRGKLIRTIERKYYKEELKQILLKQTEFHNELKDDSLYYDCLRELYRNNESHQLFLEKKNFAQLFIEDIIFYQRPLRSQKSLISNCPLEFYKFKDSVGNEKVQHLKAIPKSNPFYQEFRIWQWISNLSIYSKLDDSNFTSHFFDSTDDWESLFEMLNGRKEIEQKQLLKFLLEKKGFKGKSLSSEIEKYRWNYVEDKKYPCNETRSLIQSRLDKVANLPESFLTRHVEQELWHLIYSVTDKIEFEKALDTFSKKYKIDTPTFVDAFKKCPPFKSEYGSFSEKAIKKLLPLMRTGKYWDLDNIDKATKQRIEKIISGEYDKDIRDRVREKAINLLSETDFNRLQLWLAQYIVYDRHSEATSLDKWETIDDIVTYLHSFKQHSLRNPIVEQVITETIRVVKDIWSNYGNGSKDYFNEIHVELGREMKLPAEERKRIQEKNSQNEDTNLRIKALLSEMQNDPNVENVRPYSPVQQEILKIYEEGVLNSNIEIADDILKISKTAQPSSSDLKRYKLWLEQKYQSPYTGEIIPLNKLFTPEYEIEHIIPQSRYFDDSYNNKVICESAVNKLKDNSLGYEFIKGYNGQIVECGFGKKVKIFSIDEYEDFVQKNYANNRSKASRLMMADIPEKMIERQLNDTRYISKYISNILSNIVRSESNDDGVNSKNLISVNGKITTVLKKDWGMNDIWNDLILPRFIRMNQITDSDSFTTWNERFQKFIPTVPIELSKNFSAKRIDHRHHAMDALVIACATRDHVNLLNNLYAKSSARYDLNRKLRIFEKTTYKDIKTGQIIEREIPKAFLKPWQNFTTDAKDAIESIIVSYKQSLRVINKSTNYYQKWVEKDGIVKKEKIKQEGKNWAIRKPLHKDTVSGLVQLSWVKVPKGKVMTATRKSLDSSFDLKTIATITDTGIQKILIKYLESKGNNPESAFSPEGIEDFNNNIHLYNDGKKHRPITKVRLYEIGSKFPLGEKGNKNAKYVEAAKGTNLFFAVYANNKGERSFETIPLNLVIDRLKLGLSAVPETNEKGDNLLFHLSPNDLVYVPSEDEMENLKLINLEHISKDQLNRIYKMVSSTSNRCFFIKSEIALSIVNKIEYSPLNKMEKSIEGIMIKDVCLKLQVNRIGNLERYFS

SEQ ID NO: 1204 - protein, 1418 aa, Artificial Sequence
  Cas9
MKVKNILGLDIGVTSIGFAHVTENEKDNKSHIKQLGVRINPLTVDEQTNFEKGRPASVNADRTLKRGARKMLSRYKDRRKNLIEILSKTGFINSESILAEDGKNTTHSTWALRAKASRERIEKDELGRVLLAINKKRGYKSSRKAKNEDEGQAIDGMAIAKRLYEENLTPGQLVYQLLREGKKYIPDFYRSDLQDELDKVWNFQKQFHQEILTDTFYKDIQGKGQRATSASFYGVYGFNTAENKGSREEKRLQAYAWRSDALTKQLTREEVAFVITEINNNLNNSSGYLGAISDRSKELFFNKKTVGQYLYEQLQQNPHTRLKNQVFYRQDYLDEFETIWTIQSRYYPELTDDLKREIRDVVIFYQRKLKSQKGLVSFCELESKEIMIEKNGKAAVKKIGSKVAPKSSPLFQEFKIWQVLHNVDIKNKKDKTKRPLDDSEKEYLFNELNIKGNLKAAKVIQLLTLNKNETELNYTQLEGNRTQKALYEAYLKILDTEGYDVNNLLGIKSNKDEVFLDDLDVNALEIKTMIKQIFNALNINTGILDFDAELDGKAFEQQASYHLWHLLYSYEEDGSKSGNEHLYKLLENKFGFKPEHARILAGITLSDDYGNLSAKAMRKIYPQIKENNFSTACELVGYRHSKNSLTKEENQERPLKNKLELLKKNSLRQPVVEKILNQMINLVNELIDKNSEKDEQGSIIEYFRFDEIRIELARELKKNTDERRDLDAAIREGNLRNEKIYKLLQAQFGIKNPTRNDIIRYRLYEELKNNGYKDLYTNSYIPQEKLFGKEIDIDHIIPQSKLFDDSFSNKTLTYNTTNKDKGNQTGFDYIESKYGIDGIEAYTARIENLFESGKKNKEEGVSKAKYQKLLKKESEIGDGFIERDLRESQYIAKKAKELLLQITRSVVATSGSITARLREDWDLVNVMKELNLPKYRALGLTEMEERKYGQKVEVIKDWTKRDDHRHHAMDALTIAFTKHNHIQYLNHLNARKDEQHKEHKIINAIENKETILITDKSGNRKRVFKAPMPNFRQTAKQYLEEVLISHKAKNKVVTKNKNKILGKEKIQETLTPRGQLHDQTIYGFNWWSRITLSKKVSRNEIEKIIDNNTKFFLQEFIQLKGSIAKAFSDAELNKLMYKGKILKEIEVAIPCYTQRIDISKVFTDSQKSNSAKEKNIKNILDLKVRNILQNRLSEFKGDFKKAFSDLDKNPIWFNKEKGISIKRVIISGVKNVEPLHYKKDHLGNDILDGKENRIPVDFISTGNNHHVAIYQDEKGNLQEKVVSLFDAVKLVNADEPVIDKTYNQGLGWQFLFTMKQNEMFVFPNDNTGFDPKEIDLLDPSNKKLISPNLFRVQSISIVQYGNNIVRDFKFRNHLESVLNDDKVLHGITFQQIKSLGPLLNIVKVRINHLGDIVSVGEY

SEQ ID NO: 1205 - protein, 1419 aa, Artificial Sequence
  Cas9
MAKPQNYTIGLDIGTNSVGWTVTDDQNNILRIKSKKAIGARLFEEGKVAAERRSFRTTRRRLSRRKWRIKLLEELFDEEISKVDPNFFARSHESWISPKDKRERYSAIVFPTPEEDKKFHNEYPTIYHLRDRLMKDDQKHDIREIYVAIHHIMKYRGNFLHDESIETYRSGMSSLGGGDERTILNTKILDDLNDAFADNLATQGISVNSASADQINEIVTSGHLNVDSQKAIAKLLLPTTLSSDDKKQDKKIKKLATDAAKNVASAWLGYKANFAAILNIQEVDKDKKKIYSFALQGADEEDKVETLESVLSQDQIEIVDRIIRIRHAIVLGEIIPVGMTLSEAMIEKYDQHAKDLKNLKTVIRNLKDRKNAVKLQAIYDLYVNNRHADTAKAMKLAGVKKRTELLEPEEFNKSIEKLLDDSPVSAEIKKRIAEKDFLPLQRSNSNGVIPNQLHQIELDEIIKKQSKYYPFLGETNEHASADVARKAPTKLDQLLTFRVPYYVGPLITKEEQEEQDGHSFAWMIRKNPKDHEKITPWNFDEKVDRMASATQFIKRMTTKDTYLLGEDVLPSSSLKYQLFTVLNELNNLRINHKKLTREEKEQVIEDLFKKYKTVKADKFKNYWQKGHAGLDVKIQGMADPEKFNSTMSTYIDLQKIFGDQLDDAQRQNDFEKIIEYSTIFEDRKILGEKLRADFVWLSEDQIKRLCRLRLQGWGRLSLKLLTRLTDADGQNVLERLLNSNDNFMQIVKDPVIKAKIEQKNQKLLRADWSENATESILDEAYTSPQNKKAIRQVMRVVHDIVKACDGNLPAKFAIEFARSQDDDPKRTVARADRLQKIYAQISDEVVSQGVKDQLSGMKSLKDRYYLYFMQGGRDAYTGKPLNIDRLSDYDIDHIMPQSFIKDDSLDNRVLVTRAVNNQKSDNVPVLLYGNHLVADLGITIREMWDRWQKSGMISKRKLANLLTDPATLSEYRAEGFINRQLVETSQVIKLTATILQSEFPDSKIIEVPAKYNSILRKQFDLYKSREVNDYHHAIDAYLSTIVGNYLYQVYPNLRRLFVYGEFKKFSHGEEESSHQAVRRVKSMNFLDDLLRGKHGDDIYCRVTGEVIFSRKDIISKLKQAYSFKQMLVTQEVFTKKSALFDQTVYPSPARDSKTRSGLIPRKQGMDTEIYGGYSGNKDAYFVLAQVVKSKGHTLQVVGVPIRALRALANCSNYSEQLLKIVKAQVLFNKKTGKAKKGISDVRILLDKIPYRQPVLDGSAFYMLGSSTYKYNLKQISLSQQSMKYILDYIDDPNFNKHEMTKIDQQNEKECLLSVYDEILDKMDKYLSLYDINGFRKKLHVGRDKFIKLEVEKQAEAIKNVLRGFHANSDMTKLSDLGLSTSLGFMQASDGIKLSDNAVFIYQSPTGLFERRVKVSDLLK

SEQ ID NO: 1206 - protein, 1419 aa, Artificial Sequence
  Cas9
MMIKNILGLDLGTNSIGWALIKQNFENKYGEILGMGSRIIPMSQDVLGEFGKGNSVSQTAARTGYRGVRRLRERFLLRRERLHRVLNVLNFLPEHYASQIDFEKRFGKFKYETEPKLAYNNDGFFFKNSFDEMLGDFKDHQFHLLENGRKVPYDWTIYYLRKKALSQKIEKEELAWILLNFNQKRGYYQLRGEDFEEEKDRVFVRLKVDRVVDSGENIKGKILYDVYFENGWKYEKQIVKTEDWIGRTKEFIVTESILKNGDTKRTFKAVDSEKDWIAIKTKTEQEIDKSHKTVGAYIYEALLQNPKQKIKGKLVRTIERKFYREELKKILERQKEFHPELQSDDLYNDCIRELYRNNEAHQITLSKKDFVHLLLNDLIFYQRPLRSQKSSVSNCTLEFRKYKDENGVEHAQYLKTIPKSNPYYQEFRVWQWMFNLNIYRKDDDTNVTKEFLSSTEDYETLFEFLNNRKEVDQKALLRHFKLNEKTHRWNYVEDKKYPCNETKTMISTRLEKVENYPSDFLTREMEQNIWHIIYSVNDKIEYEKALKSFAHKNNLDENSFFEAFKKFPPFKSEYGSFSEKAIKKLLPLLRLGKYWNWESIDRKSQGRIEKIITGEFDGNIKDKVREKAIHLTAENDFQGLQLWLAQYIVYGRHSEASMIGKWNSADDLEEFLKGFKQHSLRNPIVEQVITETLRVVKDIWLKYGNGAKDFFSEIHIELGREMKQTKDERVDATKRITENENTNLRIKALLAEMMNDNSVENIRPYSPMQQEILKIYEDGILKSDIEIDDDILKISKTAQPSSSDLKRYKLWLEQRYKSPYTGQIIPLNKLFTSEYEIEHIIPQSRYFDDSFSNKIICESAVNKLKDNYIGLGFIKQFGGMIVECGFGKSVEIFKAEEYEDFVKKHYANNRSKRNKLLLEEIPEKMIDRQLNDTRHISKYISGVLSNIVRQEDGTDEGVNSKNIVPGNGKITTQLKQDWGLNDVWNELILPRFERMNQLTNSTDFTSWNKNHQKFLPTVPIEFSKGFSKKRIDHRHHAMDALVIACATKDHINLLNNQSAKSDTKRYDLKRKLMKFERVVYSHSKTGEKIEKEVPKQFLKPWDNFTVDAKNKMETIIVSFKQNLRVINKATNHYEKWIEKDGIKRKELIKQEGTNWAIRKPMHKETVSGKVDLPGIKIPKGKILTATRKSLDTSFDLKTINSITDTGIQKILKNYLEFKGSSELAFSPEGIEDMNKNIEKFNDGKPHQSINKVRIFELGSKFSVGQTGNKKDKYVEAAKGTNLFFAVYEDKNGKRSYETIPLNEVIERQKQGLDSVSFKNKEDFLLCPNDLVYVPSEDELENIYNIDFKNLTTEKTGNIYKVVSFSGNQIFFIRQDIAISIVNKAEFSTLNKMERAIDGSMIKENCIKLKIDRLGNIAKI

SEQ ID NO: 1207 - protein, 1420 aa, Artificial Sequence
  Cas9
MAKPKDYTIGLDIGTNSVGWVVTDDQNNILRIKGKKAIGARLFTEGKVAAERRSFRTTRRRLSRRRWRIKMLEELFDEEIAKVDPSFFARLHESWISPKDKRKRYSAIVFPSPEEDKKFHESYPTIYHLRDKLMKDDQKHDIREIYIAVHQMIKARGNFLHDESVETYRSGMSSLGGRSERTILSVQTLEELNDLFAENEGTEEVELNVASAEQINDILTGGHLNADSQKEISNLLLPSSFPSFDDKAKEKQVKKLINNVATNISKAWLGYKADFSTILNLAKVDKDQKKIFAFALQGEDEEDKVQELESLLEQSQTDIVDRLIEIRHAIVLSEIVPVGMTLSEAMIDKYDQHKEDLITLKAVIRNTKDKKKAAKLQAIYDLYVKNRHADLAKAMKLTGIKKRSELLDPEELKKGISSLLDDSPEAVEIKQRLEEKTFLPLQRSNNNGVIPNQLHQVELDEIIKKQSKYYPFLAEKNPDESEEAQKKAPTKLDALLTFRVPYYVGPMITKEEQEAQNGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAKHIGADIKVKGLSDPSKFNSTMSTYIDFKKIFGDQLNDVNRQNDFEKIIEYSTIFEDRKILEDKLRADFAWLSEEQIKQLCRLRLQGWGRLSDKLLTRLTDADGQNVLERLWNSNDNFVQIVSDPNIKAKIEQENQKLLRDSQSDNAVESILDDAYTSPQNKKAIRQVMRVVHDIVKACDGNVPAKFAIEFARSQEDDPKRTTARVNQMQKIYDQISDEVVSQGVKEQLSGMKSLKDRYYLYFMQGGRDAYTGAKLNIDRLSDYDVDHIMPQSFVKDDSLDNRVLVARAVNNQKSDKVPALLFGNKVVADLGITVREMWDKWQKLGMISKRKLSNLLTDPDALTEYRAQGFIRRQLVETSQVIKLTATILQSEFPDSKIIEVPAKYNSIVRKQFDLYKSREVNDFHHAIDAYLSTIVGNYLYQVYPNLRRMFVYGEFKKFSSNAEESAHDVARRVKSMNFLDDLLRGTHGDNIYCRSTGEIVFNRNDIISKLKQAYSFKQMLVTQEVFTRKSALFDQTVYPSPERDSKKRSGLIPRKKGMDPEIYGGYAHNQDSYFVLAKIEKVKGYTLQIVGVPIRSLEIINKAEDFSTALLDIIKSKVMYNEKTGQPKRGIKNVEILVNKLPYRQPILEKDVSYMLGSSAYKYNMKQITLSRQSMKYILDYIDDPNFTKHEMTMIDEQNERECLLSVYDEILEKVDKYLPLFDGNKFREKLHSARKEFVSLSVDDEASAIEKILRGLHANSEMPSLENLKIKPALGFFQMKNGITLSNDAVLLYQSPTGLFERRVKVSDLLK

SEQ ID NO: 1208 - protein, 1420 aa, Artificial Sequence
  Cas9
MAKPKDYTIGLDIGTNSVGWVVTDDQNNILRIKGKKAIGARLFTEGKVAAKRRSFRTTRRRLSRRRWRIKLLEELFDEEIAKVDPSFFARLHESWISPKDKRKRYSAIVFPSPEEDKKFHESYPTIYHLRDKLMKDDQKHDIREIYIAVHQMIKARGNFLHDESVETYRSGMSSLGGRSERTILSVQTLEELNDLFAENEGTEEVELNVASAEQINDILTGGHLNADSQKEISNLLLPSSFPSFDDKAKEKQVKKLINNVATNISKAWLGYKADFSTILNLAKVDKDQKKIFAFALQGEDEEDKVQELESLLEQSQTDIVDRLIEIRHAIVLSEIVPVGMTLSEAMIDKYDQHKEDLITLKAVIRNTKDKKKAAKLQAIYDLYVKNRHADLAKAMKLTGIKKRSELLDPEELKKGISSLLDDSPEAVEIKQRIEEKTFLPLQRSNNNGVIPNQLHQVELDEIIKKQSKYYPFLAEKNPDESEEAQKKAPTKLDALLTFRVPYYVGPMITKEEQEAQNGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAKHIGADIKVKGLSDPSKFNSTMSTYIDFKKIFGDQLNDVNRQNDFEKIIEYSTIFEDRKILEDKLRVDFAWLSEEQIKQLCRLRLQGWGRLSDKLLTRLTDADGQNVLERLWNSNDNFVQIVSDPNIKAKIEQENQKLLRDSQSDNAVESILDDAYTSPQNKKAIRQVMRVVHDIVKACDGNVPAKFAIEFARSQEDDPKRTTARVNQMQKIYDQISDEVVSQGVKEQLSGMKSLKDRYYLYFMQGGRDAYTGAKLNIDRLSDYDVDHIMPQSFVKDDSLDNRVLVARAVNNQKSDKVPALLFGNKVVADLGITVREMWDKWQKLGMISKRKLSNLLTDPDALTEYRAQGFIRRQLVETSQVIKLTATILQSEFPDSKIIEVPAKYNSIVRKQFDLYKSREVNDFHHAIDAYLSTIVGNYLYQVYPNLRRMFVYGEFKKFSSNAEESAHDVARRVKSMNFLDDLLRGTHGDNIYCRSTGEIVFNRNDIISKLKQAYSFKQMLVTQEVFTKKSALFNQTVYPSPKRDGSKRSGLIPRKRGMDPEIYGGYAHNQDSHFVLAKIEKVKGYTLQIVGVPIRSLEIINKAEDFSTALLDIIKSKVMYNEKTGQPKRGIKNVEILVNKLPYRQPILEKDVSYMLGSSAYKYNIKQITLSRQSMKYILDYIDDPNFTKHEMTMIDEQNERECLLSVYDEILEKVDKYLPLFDGNKFREKLHSARKEFVSLSVDDEASAIEKILRGLHANSEMPSLENLKIKPALGFFQMKNGITLSNDAVLLYQSPTGLFERRVKVSDLLK

SEQ ID NO: 1209 - protein, 1420 aa, Artificial Sequence
  Cas9
MAKFNKNYSIGLDIGVSSVGYAVVTDDYRVPAFKFKVLGNTEKEKIKKNLIGSTTFVPAQSAQGTRVFRVNRRRIDRRNHRIAYLRDIFQKEIEKVDKNFYRRLDESFRVLGDKSEELQIKQPFFGDKELETAYHKKYPTIYHLRKHLADADKNSPVADIREVYMAISHILKYRGHFLTLDRINPNNINMQNSWIDFIESCQEVFDLEISDESKTIVAIFKSSDNRQEKVKKILSYFQQELLKKDKSIFKQLLQLLFGLKTKFKDCFELEEEPDLNFSKENYDENLENFLGSLEEDFSDVFAKLKVLRDTILLSGMLTYTGTTRARFSATMVERYEEHRKDLQRFKSFVKQNLSEQDYLDIFGRKTPNGFDVDKETKGYVGYISNKMVLTNPQKQKTIQQNFYDYISGKITGIEGAEYFLNKISDGTFLRKLRTTDNGAVPNQIHAYELEKIIDRQGEDYPFLLENKDKLLSILTFKIPYYVGPLSKGNNSRFGWIKRTISQDILDDNDEDTRNGKIRPWNYQKLINMDETRDAFITNLIGNDIILLNEKVLPKRSLIYEEVMLQNELTRVKYKDKYGKTHFFDSELRQEIINNLFKTNNKRVSSAMLLDYLENYTNLQAVEIVSGIEKGKSLNSTLKTYNDLKTIFSEELLDSEIYQKELEEIVKVITVFDDKKSIKNYLIKYFGHLEFLNEERINQLSKLRYTGWGRYSAKLLLDIRDEDTGFNLMQFLRNDDENRNLSQLISDSTLSFDSAIKSIQSKSTVEDDVFDEIKKLAGSPAIKRGILNSIKIVDELVQIIGYPPQNIVIEMARENMTTEEGQKKAKTRKTKLESALKNIENSVLENGKVPHSDEQLQSEKLYLYYLQNGKDMYSLDKTGSPTPLYRDQLDQYEVDHIIPYSFLPIDSIDNKVLTHRENNQRKLNNIPDKETVANMKPFWEKLYNAKLISQTKYQRLTTSERTPDGVLTESMKAGFIERQLVETRQIIKHVARILDNRFLDTKIIALKSQLITNFRNTFHIAKIRELNDYHHAHDAYLAVVVGQTLLKAYPKLAPELIYGHHAHFNRHEENKATIRKHLYSNIMRFFNNPDSKVSKDIWDCNRDLPIIKEVIYNSQVNFVKRTMIKKGAFYNQNPVGKFNKQIAANNRYPLKTKVSSLDTSIYGGYGPMNSALSIIIIAERFNEKKGKIETVKEFHDIFIIDYKKFNNNPFQFLNDTSENGFLKKNNINRVLAFYGVPKYSLMQKNDGTRMLFESKSNLHKATQFKLTKTQNELFFHMRRLLTKSNLMDLKSESAIKESQNFILKHKEEFDNISNQLSAFSQKMLGDTTSLRNLIKGYNERKIKEIDSSEEVIKYFYDNFIKMFSFVKSGAPKGINDFFNNKYTVARMRPKPDKKFLNATLIHQSITGLYETRIDLSKLGED

SEQ ID NO: 1210 - protein, 1420 aa, Artificial Sequence
  Cas9
MAKFNKNYSIGLDIGVSSVGYAVVTDDYRVPAFKFKVLGNTEKEKIKKNLIGSTTFVPAQSAQGTRVFRVNRRRIDRRNHRIAYLRDIFQKEIEKVDKNFYRRLDESFRVLGDKSEELQIKQPFFGDKELETAYHKKYPTIYHLRKHLADADKNSPVADIREVYMAISHILKYRGHFLTLDRINPNNINMQNSWIDFIESCQEVFDLEISDESKTIVAIFKSSDNRQEKVKKILSYFQQELLKKDKSIFKQLLQLLFGLKTKFKDCFELEEEPDLNFSKENYDENLENFLGSLEEDFSDVFAKLKVLRDTILLSGMLTYTGTTRARFSATMVERYEEHRKDLQRFKSFVKQNLSEQDYLDIFGRKTPNGFDVDKETKGYVGYISNKMVLTNPQKQKTIQQNFYDYISGKITGIEGAEYFLNKISDGTFLRKLRTTDNGAVPNQIHAYELEKIIDRQGEDYPFLLENKDKLLSILTFKIPYYVGPLSKGNNSRFGWIKRTISQDILDDNDEDTRNGKIRPWNYQKLINMDETRDAFITNLIGNDIILLNEKVLPKRSLIYEEVMLQNELTRVKYKDKYGKTHFFDSELRQEIINNLFKTNNKRVSSAMLLDYLENYTNLQAVEIVSGIEKGKSLNSTLKTYNDLKTIFSEELLDSEIYQKELEEIVKVITVFDDKKSIKNYLIKYFGHLEFLNEERINQLSKLRYTGWGRYSAKLLLDIRDEDTGFNLMQFLRNDDENRNLSQLISDSTLSFDSAIKTIQSKSTVEDDVFDEIKKLAGSPAIKRGILNSIKIVDELVQIIGYPPQNIVIEMARENMTTEEGQKKAKTRKTKLESALKNIENSVLENGKVPHSDEQLQSEKLYLYYLQNGKDMYSLDKTGSPTPLYRDQLDQYEVDHIIPYSFLPIDSIDNKVLTHRENNQRKLNNIPDKETVANMKPFWEKLYNAKLISQTKYQRLTTSERTPDGVLTESMKAGFIERQLVETRQIIKHVARILDNRFLDTKIIALKSQLITNFRNTFHIAKIRELNDYHHAHDAYLAVVVGQTLLKAYPKLAPELIYGHHAHFNRHEENKATIRKHLYSNIMRFFNNPDSKVSKDIWDCNRDLPIIKEVIYNSQVNFVKRTMIKKGAFYNQNPVGKFNKQIAANNRYPLKTKVSSLDTSIYGGYGPMNSALSIIIIAERFNEKKGKIETVKEFHDIFIIDYKKFNNNPFQFLNDTSENGFLKKNNINRVLAFYGVPKYSLMQKNDGTRMLFESKSNLHKATQFKLTKTQNELFFHMRRLLTKSNLMDLKSESAIKESQNFILKHKEEFDNISNQLSAFSQKMLGDTTSLRNLIKGYNERKIKEIDSSEEVIKYFYDNFIKMFSFVKSGAPKDINDFFNNKYTVARMRPKPDKKFLNATLIHQSITGLYETRIDLSKLGED

SEQ ID NO: 1211 - protein, 1420 aa, Artificial Sequence
  Cas9
MAKFNKNYSIGLDIGVSSVGYAVVTDDYRVPAFKFKVLGNTEKEKIKKNLIGSTTFVPAQSAQGTRVFRVNRRRIDRRNHRIAYLRDIFQKEIEKVDKNFYRRLDESFRVLGDKSEELQIKQPFFGDKELETAYHKKYPTIYHLRKHLADADKNSPVADIREVYMAISHILKYRGHFLTLDRINPNNINMQNSWIDFIESCQEVFDLEISDESKTIVAIFKSSDNRQEKVKKILSYFQQELLKKDKSIFKQLLQLLFGLKTKFKDCFELEEEPDLNFSKENYDENLENFLGSLEEDFSDVFAKLKVLRDTILLSGMLTYTGTTRARFSATMVERYEEHRKDLQRFKSFVKQNLSEQDYLDIFGRKTPNGFDVDKETKGYVGYISNKMVLTNPQKQKTIQQNFYDYISGKITGIEGAEYFLNKISDGTFLRKLRTTDNGAVPNQIHAYELEKIIDRQGEDYPFLLENKDKLLSILTFKIPYYVGPLSKGNNSRFGWIKRTISQDILDDNDEDTRNGKIRPWNYQKLINMDETRDAFITNLIGNDIILLNEKVLPKRSLIYEEVMLQNELTRVKYKDKYGKTHFFDSELRQEIINNLFKTNNKRVSSAMLLDYLENYTNLQAVEIVSGIEKGKSLNSTLKTYNDLKTIFSEELLDSEIYQKELEEIVKVITVFDDKKSIKNYLIKYFGHLEFLNEERINQLSKLRYTGWGRYSAKLLLDIRDEDTGFNLMQFLRNDDENRNLSQLISDSTLSFDSAIKSIQSKSTVEDDVFDEIKKLAGSPAIKRGILNSIKIVDELVQIIGYPPQNIVIEMARENMTTEEGQKKAKTRKTKLESALKNIENSVLENGKVPHSDEQLQSEKLYLYYLQNGKDMYSLDKTGSPTPLYRDQLDQYEVDHIIPYSFLPIDSIDNKVLTHRENNQRKLNNIPDKETVANMKPFWEKLYNAKLISQTKYQRLTTSERTPDGVLTESMKAGFIERQLVETRQIIKHVARILDNRFLDTKIIALKSQLITNFRNTFHIAKIRELNDYHHAHDAYLAVVVGQTLLKAYPKLAPELIYGHHAHFNRHEENKATIRKHLYSNIMRFFNNPDSKVSKDIWDCNRDLPIIKEVIYNSQVNFVKRTMIKKGAFYNQNPVGKFNKQIAANNRYPLKTKVSSLDTSIYGGYGPMNSALSIIIIAERFNEKKGKIETVKEFHDIFIIDYKKFNNNPFQFLNDTSENGFLKKNNINRVLAFYGVPKYSLMQKNDGTRMLFESKSNLHKATQFKLTKTQNELFFHMRRLLTKSNLMDLKSESAIKESQNFILKHKEEFDNISNQLSAFSQKMLGDTTSLRNLIKGYNERKIKEIDSSEEVIKYFYDNFIKMFSFVKSGAPKDINDFFNNKYTVARMRPKPDKKFLNATLIHQSITGLYETRIDLSKLGED

SEQ ID NO: 1212 - protein, 1420 aa, Artificial Sequence
  Cas9
MAKFNKNYSIGLDIGVSSVGYAVVTEDYRVPAFKFKVLGNTEKEKIKKNLIGSTTFVPAQSAQGTRVFRVNRRRIDRRNHRIAYLRDIFQKEIEKIDKNFYRRLDESFRVLGDKSEDIQIKQPFFGNKELETAYHKKYPTIYHLRKHLADADKNSPVADIREVYMVLSHILKYRGHFLTLGKIDPNNINMQNSWIDFIESCQDAFDLEISDESKTIAAIFKSSENRQEKVKQILSYFQQELLKKDKSIFKQLLQLLFGLKTKFKDCFELEEEPDLNFSKENYDENLENLLGALEEDFSDVFAKLKILRDTILLSSMLTYTGATHARFSATMVERYEEHRKDLQRFKSFVKQNLSEQDYLDIFGRKTPTGFDVDKETKGYVGYISNKMVLTNPQKQKTIQQNFYDYISGKITGIEGAECFLNKISDGTFLRKLRTTDNGAIPNQIHAYELEKIIERQGRDYPFLLENKDKLLSILTFKIPYYVGPLAKGNNSRFAWIKRTTSQDVLDDNDEDTRNGKIRPWNYHKLINMDETRDAFIINLIGNDIILLNEKVLPKRSLIYEEVMLQNELTRVKYKDKYGKIHFFNSELRQEIINNLFKTNSKRVSSAMLLSYLENFTNLQAVEIVSGIEKGKSLNSTLKTYNDLKTIFSEELLDSEIYQKELEEIIKVITVFDDKKSIKNYLTKYFGHLEFLNEEKINQLSKLRYTGWGRYSGKLLLGIRDEDTGFNLMQFLRNDDENRNLTQLISDTTLSFDSAIKAIQSKSTVEDDVFEEIKNLAGSPAIKRGILNSIKIVDELVQIIGYPPQNIIIEMARENMTTEEGQKKAKTRKSKLESALKNIEDSVLESGKVPHSDEQLQSEKLYLYYLQNGKDMYSLDKTGSPTPLYRDQLDQYEVDHIIPYSFLPIDSIDNKVLTHRENNQRKLNNIPDKETVANMKPFWEKLYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHAHFNRHEENKATLRKHLYSNIMRFFNNPDSKVSKDIWDCNRDLPIVKDVIYNSQINFVKRTMIKKGAFYNQNPVGKLNKQIAANNRYPLKTKVSSLDTSIYGGYGPMNSALSIIIIAERFNEKKGKIETVKEFHDIFIIDYEKFNNNPFQFLNNVSEEGFLKKNDLNRVLAFYRISKYSLMQKIDGTRMLFESKSNLHKVTQFKLTKTQNELFFHMKRLLTKSNLMDLKSESAIKESQNFIQTHQNEFDNIADRLSNYSQKMLGETKSLQTLINGYNERPIKQIDNNEETIRYYYDNFIKMFSFVKSGAPKDIINFFNDKYTVPRMRPKPDRKMLDATLIHQSITGLYETRIDLSKLGED

SEQ ID NO: 1213 - protein, 1420 aa, Artificial Sequence
  Cas9
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 1214 - protein, 1420 aa, Artificial Sequence
  Cas9
MAKPKDYTIGLDIGTNSVGWVVTDDQNNILRIKGKKAIGARLFAEGKVAAERRSFRTTRRRISRRRWRIKLLEELFDEEIAKVDPSFFARLHESWISPKDKRKRYSAIVFPSPEEDKKFHESYPTIYHLRDKLMKDDQKHDIREIYIAVHQMIKVRGNFLHDESVETYRSGMSSLGGRSERTILSVQTLEELNDLFAENEGTEEVELNVASAEQINDILTGDHLNADSQKEISNLLLPSSFPSFDDKAKEKQVKKLINNVATNISKAWLGYKADFSTILNLAKVDKDQKKIFAFALQGGDEEDKVQELESLLEQSQTDIVDRLIEIRHAIVLSEIVPVGMTLSEAMIDKYDQHKEDLITLKAVIRNTKDKKKAAKLQAIYDLYVNNRHADLAKAMKLTGIKKRSELLDPEELKKAISSLLDDSPEAGEIKQRLEGKTFLPLQRSNNNGVIPNQLHQVELDEIIKKQSKYYPFLAEKNPDESEEAQKKAPTKLDALLTFRVPYYVGPMITKEEQEAQDGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAIHIGADIKVKGLSDPSKFNSTMSTYIDFKKIFGDQLNDANRQNDFEKIIEYSTIFEDRKILEDKLRADFAWLSEEQIKQLCRLRLQGWGRLSDKLLTRLTDADGQNVLERLWNSNDNFVQIVSDPNIKAKIEQENQKLLRDGQSDDAVESILDDAYTSPQNKKAIRQVMRVVHDIVKACDGNVPAKFAIEFARSQEDDPKRTTARVNQMQKIYDQISDEVVSQGVKEQLSGMKSLKDRYYLYFMQGGRDAYTGAKLNIDRLSDYDIDHIMPQSFVKDDSLDNRVLVARAVNNQKSDKVPAFLFGNKVVADLGITVREMWDKWQKLGMISKRKLSNLLTDPDALTEYRAQGFIRRQLVETSQVIKLTATILQSEFPDSKIIEVPAKYNSIVRKQFDLYKSREVNDFHHAIDAYLSTIVGNYLYQVYPNLRRMFVYGEFKKFSSNAEESAHDMARRVKSMNFLDDLLRGTHGDNIYCRSTGEIVFNRNDIISKLKQAYSFKQMLVTQEVFTRKSALFDQTVYPSPERDSKKRSGLIPRKKGMDTEIYGGYSGNKDAYFVLAEAVKEKGHTLQIVGVPIRALNTLKNSANYSEKLLEIIKPQVMFNKKNGKPKKGVNDVRILMDNIPYRQPVLEGGALYMLGSSTYKYSLKQITLSQESMKYILDYIDDPSFNKHIMVNIDHQDEKKCLLSVYDEILDKMDKYLPLFDINGFRKKLHDGREKFVKLPVEKQAEVVKDILRGLHANSEMTKPSDLGLTTALGFMQAPDGIKISDDAVFIYQSPTGLFERRVKVSDLLK

SEQ ID NO: 1215 - protein, 1421 aa, Artificial Sequence
  Cas9
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 1216 - protein, 1421 aa, Artificial Sequence
  Cas9
MKKILGLDLGPNSIGWALVNEAENENEKSSIIKIGSRVIHYGDNLVKVDKSGKISASMTPEEDFSSGKGLSPNAGRTKQRSARRNLQRYKQRRNNLIEILKAHSLIDNNFIFSEEGNETTFKTYKNRALAATNEISLEDFIKVLFMINKKRGYKSSRKAKGDEDGQLIDGMAIAIQLYEHNQTPGQFVYNLLKNGKKNIPDFYRSDLQTEFDRIWNFQKAFHQESLSDGICEKLVGQKKNVTSAILFKEFKIESLEIKGKWDEKRFFRYELRNKAVQQELKLNEIAECLVEINGEISNSSGYLGAISDRSKELVFQKITVGQYLYKQIAANPNTSLKKQIFYRQDYLDEFNTLWETQAKYHKELTDELKTQIRDVIIFYQRRLKSQKGLISFCEFESKQIEVFVDGKKSIKTRGMRVIPKSSPLFQEFKIWQILNNIEITDLKTKESRELTDDERQLLFEELNIRPKISKKEALKILTEKPAQYDLNYKDIEGNKTNAKFYEAYNKIIHLSGHDEIDFTDKTSDINEYLKQIFSLLGIKPEILDFDSSLKDEDFEKQLHFQLWHLLYSFEGDNTKTGDEKLLQKLNTKFGFPVEYAKVISNIALPDDYGSLSAKAIRKILPHLKDGFSYGGRKSRPDEPSACEYAGYRHSKASLTKDEKENKTYKDKLEILPKNSLRNPIVEKILNQTINVVNAVIGDYGKPDEIRLELARELKKSAEERQDATDSISKATAKHEKYRKVLQTEFGLKHISRNDLIRYKLYLELKNNGFKTLYSDTYIAPYEIFSKKFDIEHILPKAKLFDDSFSNKTLELKSVNLKKGDMTAYDFVKEEYGTEGLAKYEQRVQDLFLNKKRNEDLDQENESRITDEKISKTKRDKLLMPENKIPTGFIDRELRDSQYIAKKAKTMMEDICKDVVTTTGSVTDRLREDWQLIDIMQELNWPKYAALGLTEEFTNEEGNVIRKIKDWTKRNDHRHHAMDAITIAFTKRSHIQYLNNLSARSDKSSSIYGIEQKELYRDKNNKLRFAPPIPINEFRAEAKMQLENTLISIKAQNKVVTKNKNKISGQKKLQETLTPRGQLHLETIYGKINQYQTAEIKVGGTLDSELINKVANKKTREALLNRLAEFGNDPKKAFTVKNTIDKNPIYLDKHQSYKIPEKVKIVWQEPVYTIRKSITPDLKLDKIIDPKIKALLESRLKECNGDAKLAFSNLAENPIWLNKEKGIQIKRVTITGISNAASLHDKKDLNGKPILDEKGNKISVDFVNTGNNHHVAIYKDENGNLHDNVVTFFEAVERVNQNLPVVDKLFKQKEGWQFLFTMKQNEYFVFPNEITAFNPNEFDLLNPDNYYLISPNLFRVQTMSKVMYGNNTLRDYKFRHHLETTLQDIKELRDIVFKQFKSLSIFDKIVKVRINHLGKIVKTGEY

SEQ ID NO: 1217 - protein, 1421 aa, Artificial Sequence
  Cas9
MKDILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSHILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTESLKKELRDVVIFYQRKLKSQKSLVSFCEFENKEIEIKKEDGTSTKKVIGLKVAPKSSPLFQEFKIWQNLNNVLIRKKGSKTKKAAKNQQAVLFEEEKTISELDLEAKQALFNELNLKGNLKADYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLRDSLEVLKKNSLRQPVVEKILNQMINLVNALLKKYRTENPNFKFDEIRIELARELKKNAEERANMTANINKAKTEHEKIIKILKNEFGLPNPTRNDIIRYRLYEELKANGYKDLYTNIKIPQEKLFTKEIDIEHIIPKSRVFDDSFSNKTLSFRKTNLDKGERTAFDYMESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTEMEDRKYGQQVEVIIDWTKRNDHRHHAMDALTVAFTKHNHIQYLNYLNARKNEKHKEHSNIMGIQQLETIKVTDKNGNEKRVFKAPMPNFRQVTKAFLENILISHKAKNKVVTKNKNKVAGSNKVQEVLTPRGQLHKETVYGKYQYYVQKEEKIGGKFDLETIKKVANPLYQSLLKKRLEENGGDPKKAFTGKNSLAKNPIYLDDAQTEQLPEKVKLVWLENSFSIRKDITPENFKDEKLIDKILDEGVKRILKERLQSFGNDAKKAFSDLEKNPIWLNKEKGITIKRVTISGVANAEPLHTKKDHLGKEILDKEGKPIPVDFISTGSNHHVAVYRDEKGNLQEKVVSVFEAVVRANQGLPIIDKTYNQHLGWEFLFTMKQNEMFVFPNESTGFNPNDIDLLDPKNKRIISPNLFRVQKLATGDYWFRHHLETTVETKSATKDMTYKRLSLNHIKNIIKVRISHLGDIVSVGEY

SEQ ID NO: 1218 - protein, 1424 aa, Artificial Sequence
  Cas9
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYRSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 1219 - protein, 1424 aa, Artificial Sequence
  Cas9
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYHSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 1220 - protein, 1425 aa, Artificial Sequence
  Cas9
MRRNILGLDLGTTSIGFAKVIEDEDYQNSAVELIGVRVNPLTTDEQTNFEKGRPVSVNADRTLKRGMRRNLDRYQLRRHHLIEVLKANHIITVDTKLAEDGKNTTHATYAVRALAATAEIPLEAFARVLLAINKKRGYKSSRKAKNEDEGQLIDGMAVAKRLYEENLTPGQLSYLLLKEGKKYLPDFYRSDLNAELDKVWSFQKQFYPEILTEEFKKHLEGKGQRATSAAFWGQYGFNTAENKGSREEKKLKAYQWRSEAVDQQLTKEEVAYVITEINNDLNKSSGYLGAISDRSKELFFNKQTVGQYLYQQLKQNPHTRLKGQVFYRQDYLDEFETIWETQAKFHPELTAALKEEIRDVIIFYQRKLKSQKGLISFCEFESKEIEVEKNGLKIKKRIGLRVAPKSSPLFQEFKIWQVLNNLEFRNKSSKEVFVPDMTAKQQLFDELNIKGNLLASEAIKILGYKTKDWEANYHTLEGNRTNKSLYDAYLKILELEGYDEDLLKLSGSDDIDVSKIEKSASEIKQMVHAVFEVLGINSTILDFDAEADGKAFEQQTAYRLWHLLYSAEDDNKKYLQEDIFIYGHDNIGLKKKLCERFGFRPEHTKILVNVAFSGDYGSLSSKAMRKIYPFIKELTYDKACREAGYRHSASSLSKEEIATRPLQKRLGLLKKNELRSPVVEKILNQMVNVVNALIDDENKRRKARGLSDDFHFDEIRIELARELKKNAKERAEMTTNINAAKQLHEKIIKILQTQFGVSNPSRNDIIRYKLYEELKNNGYKDLYTNTYISPDILFSKQIDIDHIIPQMSLFDDSFSNKTVVFRKDNQDKGNKTAYDYILGKYGELALEEYISRITSLFELGKKNKEEGINKAKFQKLQKRLIDIGDGFIEKDLRESQYIAKKAKNMLYAICRSVVATSGEITARLREDWDLVNVMQEINLPKFRALGLTEMVEKKDGGQKERIIDWTKRNDHRHHAMDALTIAFTRHSHIQYLNHLNARKDEASKWHPVVSKIEEKETDLVYDDLGNRKRRFKAPMPNFREVVKEHLENVLISHKAKNKVVTKNKNKIKTAKGEKIKTELTPRGQLHKETIYGRYRYYESKEEKVGPKFDAETIGMVVNPQYRKLLLERLTTNGNDPKKAFGGKNTLSKNPLYIDEAKQELLPEKILLRWLNDDYSIRKDVTPENLKDVKTIEKVLDEGIKKILLKRLVDFGNDPKKAFSDLDKNPIWLNEAKGITIKRVTISGVKNAEALHYKKDHFGNAILNENGKLIPSSFVSTGNNHHVAIYRDAEGNLQERVVSLFDAVQLVNAGEAVIDREYNKGIGWQFLFTMKQNEMFVFPNEKTGFDPKEIDLLNTDNRKLISPNLFRVQKIASKNYFFRHHLETNVEERKELKDIVYKPQLGLNAIKDVVKVRINHLGKIISVGEY

SEQ ID NO: 1221 - protein, 1426 aa, Artificial Sequence
  Cas9
MPRKNILGLDLGTTSIGFAKIIEDDDYQCSSVELIGVRVNPLTTDEQTNFEKGKPVSVNADRTLKRGMRRNLDRYQLRRDYLIEILRTHHIITADTKLAEDGKNTTHTTYALRALAATAEIPLEAFVRVLLAINKKRGYKSSRKAKNEDEGQLIDGMAIARRLYEESLTPGQFSYQLLKEGKKYLPDFYRSDLNTELNKVWNFQKQFYPEILTDEFKRHLEGKGQRATAVAFWGQHGFSMAENKGSREEKKLHAYKWRSEAAHKQLTKEEVAFVITEINNDLNKSSGYLGAISDRSKELFFNKQTVGQYLHQQLKENPHTRLKGQVFYRQDYLDEFETIWEMQAKFYSALTLELKEEVRDVVIFYQRKLKSQMGLISLCEFESKEIEIEKNGEKAKKRIGLRVAPKSSPLFQEFKIWQVLNNLEFRNKKTKEVFVPEMAAKQQLFDELNIKGNLLASEAIKILGYKTKDWEANYHTLEGNRTNKSLYDAWLKILELEGYDENLLKLSGSDDIDVSKIEKPALEIRQMVLAVFEVLGISGAILDFDAEADGKAFEQQPAYQLWHLLYSAEDDGKKYSQEDIFTYGHDNIGLKKKLCEKFGFRPEHTKILVNVVFSDDYGNLSSKAMRRIYPFIKELTYDKACAEAGYRHSAASLTKEEIAARPLQNRLDLLKKNELRSPVVEKILNQMVNVVNTLVDDENQNRKARGLSEDFHFDEIRIELARELKKNAKERAEMTTNINTAKQSHEKIIRILQTEFGVPNPSRNDIVRYKLYEELKNNGYKDLYTNTYISRDILFSKQIDVDHIIPQMSLFDDSFSNKTVVFRKDNQDKGNKTAYDYILGKYGEQALEEYISRITSLFELGKKNKEEGIGKAKFQKLQKRLVDIGDGFIERDLRESQYIAKKANNMLYAICRSVVSTSGEITARLREDWDLVNVMQEINLPKFRALGLTEMVEKKDGAQKERITDWTKRNDHRHHAMDALAIAFTRHSHIQYLNHLNARKDEANKWHPVVSKIEEKETVLIYDDLGNRKRKFKAPMPNFREVVKEHLENVLISHKAKNKVVTKNKNKIKTVRGEKVKTELTPRGQLHKETIYGRYRYYESKEEKIGPKFDAEMIGMVTNPQYKKLLLERLAANGNDPKKAFWGKNALNKNPLYVDEARQELLPEKILLRWLNDDYSIRKDVTPENLKDIKTIEKILDKGVKKILLKRLADFGNDPKKAFSDLDKNPIWQNEAKRIAIKRVTISGIKNAAPLHHKKDHLGNDILDEKGKQIPSSFVSTGNNHHVAIYRDAEGNLQERVVSLFDAVQLVNGGEPVIDKEYNKGIGWQFLFTMKQNEMFVFPDEKTGFNPREVDLLSSGNRKLISPNLFRVQKLASKNYFFRHHLETSVEEKKELKNIAYKPQLGLNALSNIVKVRINHIGEIVSVGEY

SEQ ID NO: 1222 - protein, 1426 aa, Artificial Sequence
  Cas9
MKNILGLDLGITSISFAHIVEDENKEKSEIKELGVRIVSLTTDEQSDFEKGKSITTNANRTLKHGARLNLDRYQQRRKYLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQREFDLVWNFQKQFYPDILTDSFYKELQGKGKDATSKAFSKRYHFDTAENKGSKESVRLQAYQWRAEAISKQLSKEEVAYVLTEINNNLNNASGYLGAISDRSKELYFNRQTVGQYLYAQLQENRHNSLKNKVFYRQDYLDEFERIWETQASFHKELTDELKKQIRDVVIFYQRKLKSQKGLISFCEFESKEIEIEKDGKTITKTIGARVVPKSSPLFQEFKIWQILNNVTCKRKGIRKKKSSAKSTELDLFNEPSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIKEKVKDIFQALGICTKILYFDPLLPVKEFEKQDSYQLWHLLYSYESDDSTSGNETLYRILEKKYAFKREHARILANVALQDDYGSLSTKAIRKIYPNIKENQYSKACELAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKKFGIKNPTKSDIIRYRLYQELEHNGYKELYTNAPIARDMLFSKNIEIEHIVPKARVFDDSFSNKTLTFHRINSNKGEYTAFDYITSLNSEEELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNVNKPAGTDKQQITLTPRGQLHKETIYGKYQYYVNKEEKVGVKFDERTITKVSNPLYREALLKRLQANDNDPKKAFTGKNALSKNPIYLDETKTKTLPEKVNLTYLEEDFSIRKDISPDNFKDLKSIEKVIDQGVKRILIKRLQDYDNDPKKAFVDLEKNPIWLNKEKGIAIKRVTISGVSNAQPLHIGKDHLGKTTLNKEGNEIPVDYVSTGNNHHVAIYRDKEGNLQEQIVSFFEAVVRTQQGLPIIDKTYKQEEGWQFLFTMKQNEMFVFPNATTGFNPAEIDLLDPKNKKLISPNLFRVQKIATKDYFFRHHLETNVETDNVLKNTTWKREGLSGLKDIVKVRINHLGDIVSIGEY

SEQ ID NO: 1223 - protein, 1426 aa, Artificial Sequence
  Cas9
MKHILGLDLGTNSIGWALIKQDFENKQGEILGMGSRIIPMSQDILGDFGKGNSVSQTAERTKYRSVRRLRERFLLRRERLHRILNVLGFLPEHYASQIDFTKRFGKFKEETEPKLVYSNEGFIFKKSFEEMLSDFKTHQPQLLEDNKKIPYDWTIYYLRKKALSRKIEKEELAWILLNFNQKRGYYQLRGEEEEENPNKLIEFYSLKIVDVLADEPQKGKSDIWYSLILENGWIYRRSSKTPLFDWKEKTRDFIVTIDLNDDGSVKTDKEGNEKRSFRAPGENDWTLVKKKTEQEIDSSRKTVGTYIYETLLKNPKQKIKGKLVRTIERKFYKTELKQILEKQKEFHPELRQDDLYSDCVRELYKNNEAHQLTLSKKDFVHLFMEDIIFYQRPLGSQKSSISNCTLEFRKYKDENGTEHTQYLKAIPKSNPYYQEFRIWQWMYNLNIYKKEDDTNVTKDFLNTKADFESLFEFLNNRKEVDQKALLKHFKLNDKTHRWNYVEDKKYPCNETKTMILSRLDKVENISDDFLTREMEQKIWHIIYSVNDKVEYEKALKSFAGKNNLEDNSFFEAFKKFPPFKSEYGAFSEKAIKKLLPLMRMGKFWNYNNISEQSKSRIQKIITGEYDENIKDKVREKAIHLTTETDFQGLQLWLVQYIVYGRHSEAAMLGKWNSADDLEEFLKEFKQHSLRNPIVEQVITETLRVVKDIWQKYGNGAKDFFREIHIELGREMKLPAEERERLTRQISENENTNFRIKALLAEMMDDNSVENVRPFSPMQQEILKIYEEGVLNSDIEIEDDILKISKTAQPSSSDLKRYKLWLEQKYKSPYTGQIIPLNKLFTPEYEIEHIIPQSRYFDDSFTNKIICESAVNKLKDNYIGLEFIKKLGGSIVECGNGKSVAILKHDAYEDFIKKHYANNRSKRNKLLLEDIPEKMIERQMNDTRYISKYISGVLSNIVRVEDGTDEGVNSKNIVPGNGKITTQLKQDWGLNDVWNDLILPRFERMNHLTNSTDFTAWNENHQKFLPTVPVEFSKGFSKKRIDHRHHALDALVIACATKDHVNLLNNQSAKSDTKRYDLKKKLMKFEKVAYNHPQTGERIEREAPKQFLKPWETFTIDAKNHLETIIVSFKQNLRVINKATNYYEKYVEKEGTKVKERVEQKGTNWAIRKPMHKETVSGKIDLPRIKVPKGKILTATRKSLDTSFNLKTIGSITDTGIQKILKNYLQYKDNNPELAFSPEGIEDMNKNIEKFNNGKAHQSISKVRVFELGSKFPLGQSGNKKEKYVEAAKGTNLFFAIYQDKNGKRSYETIPLNEVIERQKQGLSVVDLKGVDDFYLSPNDLVYVPSEDELENISMIDFNKMSSERIYKVVSFTGNQIFFVRQDIATSVVNKAEFSTLNKMERAIDGTMIKETCVKLQIDRLGNISKI

SEQ ID NO: 1224 - protein, 1426 aa, Artificial Sequence
  Cas9
MYNIGLDIGTGSVGWCLTDENGYLLKVNRKGNNGNTYRNSAWGVRLFESADTAADCRIKRSTRRRYKRRRTRIIELRKIMSDMIMPIDPNFYARLDEAFLWNEDKSDKAKAPFLLFNDNGYDDVKYYTDYPTIYHLRKHLLETKEKADPRFIYLALHHMMKYRGHFLFEGQSFEAIDNIEDTFIELEHLVNVYVKEKEDTDNNAENNALYQEMKNYLADNKVKNKDKKEYITDTFIKADYDNKYSKELAAAVLGYEFNVGIIVNDNSLTDEDGKALKAKFADAKYEEKEEKLSDTLGERYYIIETLKKIYSWKVLHSILGDNKYLSYAMVDKYEKHSEQLKALKYLFHKYTSQDEYSEFFHQEKNKEGKYIVNYANYIKGIKRLSNETNKKYNTKQQLYQSIMKILGERAADDEVYKKILVEMEQETFLEKINNVDNSAIPYQLNLMEMDKILTQQGVYYKELRDNKELLLKMLTSKIPYYVGPLNNNSNGNRNFAWMTKKDGKENEKVYPWNVKDVVDIDVTAEDFITRMTNYCTYLPNEKVLPKESLLYQRYMLLEELSQIRIDGRKLSKEDRKAIINDLFIGKGRVKVSDKDFKEYLNKVNYVKVNGKGYDVTGYQSDDGFACALSSYNKFRRILGHIDEQNEKMIEDIIYWITVFEDKDIVKRKINKQYADRLSAEQLKKILKLKFKGWGRYSSKLLNGIKGDMGTTIIEMLEDADERFAYCDYCPNFMQIINKDEKIKQIIDDNRPRYDGTKDLLDVIQDMHTSPANRRGIWQTMKAIEEIIEYMGEKPQQIYIEFAREDDPKAKNKRADSRKRAIDKALKKLKEDVVDEYNEKVYKELKQYEKRLDEEKVYLYFMQNGKDLYFPDKELNLDELEKLEIDHIIPYSLSDDDSLDNKALVLKGNNQNKGNKIVKEAFPQLFSNSGTVNYWKNLKKAGLISEKKYNNLQKNNVDDILTKGFINRQLVETRQIVKSVANLILDYYNEQIDVIEVKASLSTSVRKMLTYEKKDNNGFWIENKDNCMFYKNRDMNDYHHAHDAYLANIIGLYIQKNYPRLQKELNYSQYRRIWRKYYENTKNNNGVNWFATLGKFSSNNEEADWYGQDIIAYMRKIFCYRDVLISKKVEENTGAFYSETKYPREDKAGSKLVPLKQGNNMRGANNLKELDARKYGGYKGGEKAYFVLVKYCIEKALKKKVKKEYHMEFVEIPVYIARGIKNKDINLYDYVCDILNEANKNSVADVEILRNKVPKYQMIIGENGEEYYLVSATEVINSKQFVLGGANQQYNRLLNYIKYGKNDKWQYIQTELLDEQLIGLYNLLIAKIKDEYKGFSKEAVRIQENNSFDKLDVKDKKEFIAEMIKLVQPDSDYPYLGKYATGLSNRMGRKTGEKVGKKITLVDKSVTGLYERRTTFELEDDSSTKSC

SEQ ID NO: 1225 - protein, 1426 aa, Artificial Sequence
  Cas9
MKNILGLDLGTTSIGFAHIVEDENKEKSEIKELGVRIVSLTTDEQSDFEKGKSITTNANRTLKHGARLNLDRYQQRRKYLIDLLQKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTTENKGSKESVRLQAYQWRAEAISKQLSKEEVAYVLTEINNNLNNASGYLGAISDRSKELYFNRQTVGQYLYAKLQENRHNSLKNKVFYRQDYLDEFERIWETQASFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIREKVKAIFQTLGICTKILYFDPLLPVKEFEEQDSYQLWHLLYSYESDDSTSGNETLYRILEKKYAFKREHARILANVALQDDYGSLSTKAIRKIYPNIKENQYSTACEKAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKEFGIKNPTKSDIIRYRLYQELEHNGYKELYTNAPIARDMLFSKNIEIEHIVPKARVFDDSFSNKTLTFHRINSDKGEYTAFDYITSLNSEEELNQYLTRVENAYKTKSISPTKYKNLLKKASEIGDDFINRDLRDTQYIAKKAKEILFQVTKNVLSTSGSITDRLREDWGLVDVMKELNMPKYQSLGLTEVEERKDGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNTNKPAGTDKQQITLTPRGQLHKETIYGKYQYYINKEEKIGVKFDERTIAKVSNPVYREALLKRLQANDNDPKKAFAGKNALSKNPIYLDESKTKTLPEKVNLTYLEEDFSIRKDISPDNFKDLKSIEKVIDQGVKRILIKRLQAYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFDAVVRAQQGIPIIDKTYKQAEGWQFLFTMKQNEMFVFPNATTGFNPAEIDLLDPKNKKLISPNLFRVQKIATKDYFFRHHLETNVETDNILKNVTWKREGLSGLKDIVKVRINHLGDIVSIGEY

SEQ ID NO: 1226 - protein, 1426 aa, Artificial Sequence
  Cas9
MKNILGLDLGTTSIGFTHIVEDENKEKSEIKELGVRIVSLTTDEQSDFEKGKSISTNANRTLKHGARLNLDRYQQRRKFLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQKEFDLVWNFQKQFYPDILTDSFYKELQGKGKDATSKAFSKRYHFDTAENKGSRESVRLQAYQWRAEAISKQLSKEEVAYVLTEINNNLNNASGYLGAISDRSKELYFNRQTVGQYLYAQLQENKHNSLKNKVFYRQDYLDEFERIWETQASFHKELTEELKKQIRDVVIFYQRKLKSQKGLISFCEFESKEIEIEKDGKTITKSIGARVVPKSSPLFQEFKIWQILNNVTCKRKGIRKKKSSAKSTELDLFNEPSQTIFSLDMECKQLLFEELNLKGDLKSDKVLKLLGYSPQEWEINYNQLEGNRTQKALYEAYLKIVEMEAHDVKDILQIKSTKDDWALEESPLSASEIRERVKAIFQTLGICTKILYFDPLLPVKEFEEQDSYQLWHLLYSYESDDSTSGNETLYRILEKKYAFKREHATILANVTLQDDYGSLSTKAIRKIYPYIKENQYSTACEKAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISGILQKEFGIKNPTKSDITRYRLYQELAHNGYNDLYTNTYIPKELLFSKNIDIEHIVSKARVFDDSFSNKTLAFREFNIKKGESTAFDYITSLNNEEELNQYLNRVENAYKTKNISPAKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDKNNKNYSVILAIEEKETIKVPTNNGKNKRVFIEPIPNFRQVAKKHLEEIFISHKAKNKVVTKNTNKPAGTDKQQITLTPRGQLHKETVYGKYQYYVNKEEKIGVKFDKETIAKVSNPVYREALLKRLQANDNDPKKAFAGKNALSKNPIYLDEAKTKTLTEKVNLTYLEEDFSIRKDISPDNFKDLKSIEKVIDQGVKRILIKRLQDYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFEAVVGAQQGLPIVDKTYKQAEGWQFLFTMKQNEMFVFPNEATGFNPAEIDLLDPKNKKQISPNLFRVQKIATKDYFFRHHLETNVDTDNVLKNTTWKREGLSGLKDIVKVRINHLGDIVSIGEY

SEQ ID NO: 1227 - protein, 1427 aa, Artificial Sequence
  Cas9
MKKILGLDLGTSSIGWALVNEAETSEEKSSIIKLGVRVNPLTVDELQNFEKGKSITTNADRTAGRSMRRNLQRYKLRRENLIEVLKEYNFITDEMILSENGNRTTFETYRLRAKAAVEEISLEQFARVLLMINKKRGYKSSRKAKGAENGTLIDGMEVAKKMYDEGITPGELCLQLLTAGKRYFPDFYRSDLQAEFDRIWNFQKQFYPDSLIDKVKDEVRGKNKSQTWAILAKYFVWKEVENSWNEEEAQTRRVEKEYRLVGIKRGVKREELKLENFQWRVKALSERMNPEELAIVLQEINEQISNSSGYLGAISDRSKELYFNRQTVGQYQMAVLDNNPNIGLRNMVFYRQDYLDEFNTIWEKQAEFHKELTEDLKKEIRDIVIFYQRRLKSQKGLINICEFERRQIEVEIDGKKKIKTIGSRVIPRSSPLFQEFKIWQTLNDIEVSVLGVKNKRKKQDDNSTTLLDSAENIDSLKLNVSRPLDADEKSLLAKELFIRDKLTKSDVLKLLFNNPQNLNLNFKNIDGNRTGSALYQAFSKILEISGHESINFKKSADEIVEQVKTIFSALGWNTEVLCFDSEKELDKQPYFKLWHLLYSFEGDSTPTGDGNLIQKIADLCGFEKDYASILANITFQEDYGSLSTKAIRKILPHLKDGNQYDVACEYAGYKHSKSSLKKEEIKNKVLKDKLELLPKNSLRNPVVEKILNQMVNVINAIITTYGKPDEIRIELARELKKNAKEREELTKSIVDTTKTHEGIRAILQNDFGMSHVSRNAIIRYKLYEELKDNGYKTLYSNTYIPKEKLFSKDFDIEHIIPQARLFDDSFSNKTLEVKSINIEKGSKTAYDFVEEKYGEQGLQEYLNRCEVLFRDKKTKLRKLKMQESEIPEGFIDRDLRNTQYIAKKALSMLNEICRRVVATTGAITDELREDWQLVDVMKELNWEKYKVLGLVEYFEDNDGRLIGRIKDWTKRNDHRHHAMDALTVAFTKDVFIQYFNNKNASLKPDTNEAAIRNKYFQNGKAIPPMSLDEFRAEAKKHLNDTLISIKTKNKVVTINLNRTKKKNGINKKQQQTPRGQLHLETVYGSHKQYVVKEEKVNASFDAAKIATVNKPAYRDALLRRLQENGNDSKKAFTGKNSLDKQPVWLDAKQNECVPEKVKTVMLETVYTVRKPIDEKLNVDKVVDARIRKLLQDRIKEYGNAKSAFANLDENPIWLNKEKGITIKRVSVSGISKAQSLHEKKDKDGNFILDKDSRRIPVDFVNTGNNHHVAIYRKPVLDKKGQAVFDENGELKFELEEVVVSFFDAVTRVNLSQPIIDKDYKRSEGWKFLFSMKQNEYFVFPNEKTGFDPKEIDLLNPENYALISPNLFRVQKIASKDYVFRHHLETVVADRKELQEITWKRISSLSILNRIIKVRVNHIGQIVMIGEY

SEQ ID NO: 1228 - protein, 1427 aa, Artificial Sequence
  Cas9
MAKPKDYTIGLDIGTNSVGWVVTDDQNNILRIKGKKAIGARLFAEGKVAAERRSFRTTRRRLSRRRWRIKLLEELFDKEIAKVDPSFFARLHESWISPKDKRKRYSAIVFPSPEEDKKFHESYPTIYHLRDKLMKDDQKHDIREIYIAVHQMIKARGNFLHDESVETYRSGMSSLGGRSERTILSVQTLEELNDLFAENEGTEEAKLNVASAEQINDILTGGHLNADSQKEIGNLLLPSSFPSFDDKAKEKQVKKLIKNVATNISKAWLGYKADFSTILNLANVDKDQKKIFAFALQGGDEEDKVQELESLLEQSQTDIVDRLIEIRHAIVLSEIVPVGMTLSEAMIDKYDQHKEDLITLKAVIRNTKDKKKAAKLQAIYDLYVNNRHADLAKAMKLTGIKKRSELLDPEELKKAISSLLDDSPEAVEIKQMLEEKTFLPLQRSNNNGVIPNQLHQVELDEIIKKQSKYYPFLAEKNPDESEEAQKKAPTKLDALLTFRVPYYVGPMITKEEQEAQDGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAKHIGADIKVKGLSDPSKFNSTMSTYIDFKKIFGDQLNDVNRQNDFEKIIEYSTIFEDRKILEDKLRADFAWLSEEQIKQLCRLRLQGWGRLSDKLLTRLTDADGQNVLERLWNSNDNFVQIVSDPNIKAKIEQENQKLLRDGQSDDAVESILDDAYTSPQNKKAIRQVMRVVHDIVKACDGNVPAKFAIEFARSQEDDPKRTTARVNQMQKIYDQISDEVVSQGVKEQLSGMKSLKDRYYLYFMQGGRDAYTGAKLNIDRLSDYDIDHIMPQSFVKDDSLDNRVLVARAVNNQKSDKVPALLFGNKVVADLGITVREMWDKWQKLGMISKRKLSNLLTDPDALTEYRAQGFIRRQLVETSQVIKLTATILQSEFPDSKIIEVPAKYNSIVRKQFDLYKSREVNDYHHAIDAYLSTIVGNYLYQVYPNLRRMFVYGEFKKFSSNAEESAYDVVRRVKSMNFLDDLLRGTHGDNIYCRSTGEIVFNRNDIISKLKQAYSFKQMLVTQEVFTKKSALFDQTVYPSPERDSKKRSGLIPRKKGMDTEIYGGYSGNKDAYFVLAEAVKEKGHTLQIVGVPIRALNTLKNSANYSEKLLEIIKPQVMFNKDTGKPIKGIKDVKILMDKIPCRQPVLEGESYYMLASSKYRYSLKQISLSQMSMKYILDYIDDPNFNKHEMINIDQQDEKECLLSVYDEILEKMDKYLPLFDIRSFRKKLHDGRDAFIALPVASEEKKPGKVDVIRKVLKGLHANADITNLAELGFGTAALGALVSTGGIKISDDAVFIYQSPTGLFERRVKVSDLLK

SEQ ID NO: 1229 - protein, 1428 aa, Artificial Sequence
  Cas9
MKKILGLDLGTTSIGSAYVLEAEKSAEQTKIVYLGTRIILSSADAENFSKGLSCSPTTDRTFKRSMRRRLQRYKQRRSSLIQQFKKIGIITNTEQIIREPISETHELLRIRSKAVSERVSLEEFARILLTINKRRGYKSNRKTSKSTEEDGKLVDAMAVTKELIKLKKTPGQYMFERFKRGKYAEIDFYPFDLINELKQIWEVQGQKYPDVLTEDLLSSLLKQKTGKAKELIYSKSDLNPAEVPIDYQKGKKLRKTILNKYFAYESRSLAATNIIPVEQVITAIVAICKQINNSSGYLGAIGDRSRVLYANNQTIGQYLYERIKANPHDRIRGEVFYRQDYLDEFDRIWECQQNYYPAILTNDRKQFIRNRIIFYQRPLKSKKSELAFCEFESREVEHNGKKYTEGLHVAPKSSPVFQHFRLWQRLGQIEVSPLRKWNKQSNELFEQQNDTDQERILNTEAKQKLFSYLNLLDHLTDNEILNILGYSPDKWKINFREIIGNRTNNSMMKAFFNMKEMTDGEQINWEKNLTKITNGQSLISPEQIVDLIRQFFEREGITTSLLYFDPTTDNFREQSHYSLWHLLYSYEDDNSPTGTTSLCKTLAKRYGIPHELCPLLASLTFEPQYGSLSTKAMRKILPFMQENGYDKACELAGYRHSAWTTKEENTERTLKNSLPLLRKGSLRNPVVEKILNQMTHVINTHISEYGNPDEIRIEMARDMQANSKQRKAMTTAIAEATKRNTQFIEEIQKEFGFNPSKNDLIKYKLWKELAPLGSKTLYSNTYIPKEELFTAKFEIEHIIPRALFYDDSFSNKTLELNSVNKLKGNKTALDYMDTLSQEQANDYIIRVEELKKIGAITQAKYKKLLIREKDLGDDFTNRDLTNTRYIIRHAADMLLQVTPSIVHTNGSITAILRRDWELLDILKELNLPTYESIDRKISDPKEKLTESVERKDGQAIKMIKDWSKRDDHRHHAMDALITALTTRKHVQYLNGNRGAEETDKVQKLQQLKALRKQLIGSDGHFIPPMHDIRVQAKEALSRVIISTKAKGKVTTPNTNIICSRDKTTGRKIYVKQTTLTPRGALHKEMQYGCNHYYLEKQIPIGSKLTEEEIRLVSSPKIRSMLSERLQAYNNDPKSAFTGRNSMDKKPLEDKNKKLVYTDKKVKQTILANRFVKRDRVNSKLDLDKVIDTGIKRILERRLKQYGGKYETAFSDLENNPIWLNEEKGIAIKSVRIRGKNNTITIRQTNTCRIKYVANDNNHHLAVYALPDGSIEDDIVSFFDAVERSRKGLPIIDKHKNQSLGWKFLFSVKQNEYFLLPQQGEKIDIDTGEISMQTTFSPKDLSPEYIMNPDNYAELAPHIFRVQSISKTPQGNRDVRIYLFKQQYISGSQKDSLHLKGITHRQISSAKDLAGLVKIRVNHLGRIVAVGEK

SEQ ID NO: 1230 - protein, 1428 aa, Artificial Sequence
  Cas9
MKKILGLDLGTASIGSAYVLEAEKSADQTKIVYLGTRIILSSADAENFSKGLSCSPTTDRTFKRSMRRRLQRYKQRRSSLIQQFKKIGIITNTEQIIREPISETHELLRIRSKAVSERVSLEEFARILLTINKRRGYKSNRKTSKSTEEDGKLVDAMAVTKELIKLKKTPGQYMFERFKRGKYAEIDFYPFDLINELKQIWEVQGQKYPDVLTEDLLSSLLKQKTGKAKELIYSKSDLNPAEVPIDYQKGKKLRKTILNKYFAYESRSLAVTNIIPVEQAITAIVAICKQINNSSGYLGAIGDRSRVLYANNQTIGQYLYERIKANPHDRIRGEVFYRQDYLDEFDRIWECQQNYYPAILTNDRKQYIRNRIIFYQRPLKSKKSELAFCEFESREVEHNGKKYTEGLHVAPKSSPVFQHFRLWQRLGQIEVSPLRKWDKQSNELFEQQNNADREGILNTEAKQKLFSYLNLLDHLTDNEILNILGYSPDKWKINFREIIGNRTNNLMMKAFFSMKEMTDGEQIDWEKNLTKITNGQSLISPEQIVDLIRQFFEREGITTSLLYFDPATDNFREQSHYSLWHLLYSYEDDNSPTGTTSLCKTLAKRYGIPHELCPLLASLTFERQYGSLSTKAMRKLLPFMQEKRYDEACELAGYRHSAWITKEENAKRTLKNKLPLLRKGSLRNPVVEKILNQMTHVINTHIAEYGNPDEIRIEMARDMQANSKQRKAMTAAITEATKRNTQFIEEIQKEFGFNPSKNDLIKYKLWKELAPLGNKTLYSNIYIPKEELFTAKFEIEHIIPRALFYDDSFSNKTLELNSVNKLKGNKTALDYLDTLGQEKANDYILRVEELKKIGAITQAKYKKLLIREKDLGDDFTNRDLTNTRYIIRHAADMLLQVTPSIVHTNGSITAILRRDWGLLDILKELNLPTYESIDRKISDPEEKLTQSVDRKDGQAIKMIKDWSKRDDHRHHAMDALITALTTRKHVQYLNGNSGAEETDKAQKLEQLKALRKQLIGSDGHFIPPMHDIRVQAKEALSRVIISTKVKGKVTTPNTNIICSRDKTTGRKIYVRQTTLTPRGALHLDTKYGINRYYQEREVSIGSKLTQEEIRLVSSPHIQSILLERLRAFDNNPKSAFTGRNSVDKKPLEDKNKKLVYTDKKVKQTILANRFVKRDQVNSKLNLDKVIDTGIKRILEGRLQQYGGKYETAFSDLENNPIWLNEEKGIAIKSVRIRGKNNAIPIHQTDTCPIDYVANDNNHHLAVYVLPDGTIEDDIVTFFDAVERSRQGLPIVDKNKNQSLGWKFLFSIKQNEYFLLPQQAEKIDIDTGEISTQTTFSPKDLSPEYIMNPDNYAELASHIFRVQSISKTPQGNRDVRIYLFKQQYISGSQKDSLHLKGITYRQISSAKDLAELVKIRVNHLGRIVSVGEK

SEQ ID NO: 1231 - protein, 1428 aa, Artificial Sequence
  Cas9
MTKKILGLDLGTTSIGWAYVIESDNPDESEIKQIGVRVNPLTTDEQTNFEKGKPFSINKERTLKRGARRNLDRYKDRRNNLIEVLKKANILSQDSILTEEGQHTTHQTWQLRAKAAVDKIEKEELARVLLAINKKRGYKSSRKAKNEDEGQAIDGMAVAKRLYDEQITCGQLVYQLLREGKKSIPDFYRSDLQAEFDKVWNFQKQFYPKILTDEFYKELKGKGQRATSALFYKTYNFNTAENKGSREEKKIQAYKWRSEAISQQLEKEEVAFVLTEINNNLNNSSGYLGAISDRSKELYFNKQTVGQYLYQQLQENRHARLKNQVFYRQDYLDEFEAIWKEQAKHHTELTEELKAEIRDIIIFYQRKLKSQKGLISFCEFESREIQIDGKKKTIGLRVAPKSSPLFQEFKIWQNLNNVLVRKKGSRKRNVKQEIQGSLFEEEKEIFVFDLETKEKLFEELNLKGNLSANKVIELLGHKPTEWEINYSALEGNRTNQALYNAYLKILDIEGYDEDLLKLSDKDDINVADLKTPASEIKNMVRDIFQVLGISTDILEFDAELDGKDFEQQASYQLWHLLYSYEGDDSQSGNEKLYELLEKKFGFKKEHSQVLANVTLSDDYGNLSSKAMRKIYPFIKENNYSTACELAGYRHSKHSLTKEEIENRPLDDKLELLKKNSLRQPVVEKILNQMVNVVNSLLEKNRKENPDFRFDEIRIELARELKKNAKERAEMTTNINSAKTENEKIFKLLQAEFGLKNPTRNDIIRYRLYEELKNNGYKDLYTNKYIPREILFSKQVDIEHIIPQSRLFDDSFSNKTIVYRETNLDKGNQTAFDYIDSKYGNEKVEEYILRIEALHDAWKKNKEEGISKAKYQKLLKKETEIGDGFIERDLRESQYIAKKAKEMLFKITRSVVSTSGSITDKLREDWGLINIMKELNLPKYRSLGLTEMQERKFGQKVEVINDWTKRNDHRHHAMDALTVAFTKHNHIQYLNYLNARKNENHKLHNNIIAIENLETETMIDNNGSKRRVFKAPMPNFRQVAKEHLENVLISHKAKNKVVTKNKNKIAGKVAAQETLTPRGQLHKETVYGKYQYYVNKEEKIGTKFDEETINKVSNPQYRKLLLERLSANGNDPKKAFSGKNALSKNPIYLNETKTETVPEVVKLTWLEEDYSIRKDITPDNFKDEKSIDKILDEGVKRILKKRLRKNDNDPKKAFSDLDKNPIWLNEEKGISIKRVTISGVNNAEPLHYKKDHFGNDILDEKGDKIPVDFVSTGNNHHVAVYRDEKGNLQENIVSFFEAVIRVNQGLPIIDKAYNQHLGWQFLFTMKQNEMFVFPNEKSGFNPQEIDLLDPSNKKKISPNLFRVQKMSKVIYGNSPVREYVFRHHLETNVDEKKELKDITFKNIKSLGYFEDIVKVRINHLGDIVSVGEY

SEQ ID NO: 1232 - protein, 1430 aa, Artificial Sequence
  Cas9
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSDILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVAKNQQAVLFEEEKTISELDLEAKQALFNELNLKGNLKADYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTANINKAKTEHEKIIKILKNEFGLPNPTRNDIIRYRLYEELKANGYKDLYTNIKIPQEKLFTKEIDIEHIIPKSRVFDDSFSNKTLSFRKTNLDKGERTAFDYMESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVITDWTKRNDHRHHAMDALTVAFTKHNHIQYLNYLNARKNEKHKEHSNIMGIQQLETIKVTDKNGNEKRVFKAPMPNFRQVTKAFLENILISHKAKNKVVTKNKNKVAGSNKVQEVLTPRGQLHKETVYGKYQYYVQKEEKIGAKFDLETIKKVANPLYQSLLKKRLEENGGDPKKAFTGKNSLAKNPIYLDDTQTEQLPEKVKLVWLENSFSIRKDITPENFKDEKLIDKILDEGVKRILKERLQSFGNDAKKAFSDLDKNPIWLNKEKGITIKRVTISGVANAEPLHTKKDHLGKEILDKEGKPIPVDFISTGSNHHVAVYRDEKGNLQEKVVSVFEAVVRANQGLPIIDKTYNQHLGWEFLFTMKQNEMFVFPNESTGFNPNDIDLLDPKNKRIISPNLFRVQKFSKLQYGNSFVREFVFRHHLETTVEDRKELQGITYKQMKNSTFFNDIIKVRINHLGDIVSIGEY

SEQ ID NO: 1233 - protein, 1430 aa, Artificial Sequence
  Cas9
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSHILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVDKNQQAVLFEEEKTIFELDLEAKQALFNELNLKGNLKAYYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTVNINKAKTEHEKIIKILKNEFGLPNPTRNDIIRYRLYEELKANGYKDLYTNEYIEKQDLFTKNIDIEHIIPKSRVFDDSFSNKTLSFRKTNLDKGERTAFDYIESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVIIDWTKRNDHRHHAMDALTVAFTKHNHIQYLNYLNARKNEKHREHSNIMGIQQLETIKVTDKNGNEKRVFKAPMPNFRQVTKAFLENVLISHKAKNKVVTKNKNKVAGSNKVQEVLTPRGQLHKETVYGKYQYYVQKEEKIGGKFDLETIKKVANPLYQSLLKKRLEENGGDPKKAFTGKNSLAKNPIYLDDAQTEQLPEKVKLVWLENSFSIRKDITPENFKDEKLIDKILDEGVKRILKERLQSFGNDAKKAFSDLDKNPIWLNKEKGIAIKRVAISGVANAEPLHTKKDHLGKEILDKEGKSIPVDFISTGNNHHVAVYRDEKGNLQEKVVSVFEAVVRANQGLPIIDKTYNQHLGWEFLFTMKQNEMFVFSNESTGFNPNDIDLLDPKNKKIISPNLFRVQKFSKLQYGNSFVREFVFRHHLETTVEDRKELQGITYKQMKNSAFFNDIIKVRINHLGGIVSVGEY

SEQ ID NO: 1234 - protein, 1430 aa, Artificial Sequence
  Cas9
MKDILGLDLGTNSIGWAVVKEAQNDNETSEIVDLGVRVNPLTTDEKTNFEKGKPISTNADRTLKRSARRNLQRYKLRRKELIELLKEHQLISTDTILTENGKGTSFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSHILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWNTQAQFYPQILTDELKKELRDVVIFYQRKLKSQKSLVSFCEFENKEIEIKKEDGTSTKKVIGLKVAPKSSPLFQEFKIWQNLNNVLIRKKGSKTKKAAKNQQAVLFEEEKTISELDLEAKQALFNELNLKGNLKADYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTANINKAKTEHEKIIKILKNEFGLPNPTRNDIIRYRLYEELKANGYKDLYTNIKIPQEKLFTKEIDIEHIIPKSRVFDDSFSNKTLSFRKTNLDKGERTAFDYMESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTEMEDRKYGQQVEVIIDWTKRNDHRHHAMDALTVAFTKHNHIQYLNYLNARKNEKHKEHSNIMGIQQLETIKVTDKNGNEKRVFKAPMPNFRQVTKAFLENILISHKAKNKVVTKNKNKVAGSNKVQEVLTPRGQLHKETVYGKYQYYVQKEEKIGGKFDLETIKKVANPLYQSLLKKRLEENGGDPKKAFTGKYSLAKNPIYLDDAQTEQLPEKVKLVWLENSFSIRKDITPENFKDEKLIDKILDEGVKRILKERLQSFGNDAKKAFSDLDKNPIWLNKEKGITIKRVTISGVANAEPLHTKKDHLGKEILDKEGKPIPVDFISTGSNHHVAVYRDEKGNLQEKVVSVFEAVVRANQGLPIIDKTYNQHLGWEFLFTMKQNEMFVFPNESTGFNPNDIDLLDPKNKRIISPNLFRVQTISVVKYGNAIVRDFKFRHHLETTVEDKKELQGKTYQQIKSLSPLNDIIKVRINHLGDIVSVGEY

SEQ ID NO: 1235 - protein, 1430 aa, Artificial Sequence
  Cas9
MKHILGLDLGTNSIGWAYVKEAENDTETSEIVDLGVRVNPLTTDEKTNFEKGKPISTNADRTLKRSARRNLQRYKLRRKELIELLKEHQLISENTILTENGKGTTFQTLELRAKSAKEKISLGELARVFLTINKKRGYKSSRKAKNEDEGQLIDGMEIAKRLYEENLTTGQLSLQLLKEGKKSLPDYYRSDLQFELDKVWNFQKQFHSDILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWNTQAQFYPQILTDELKKELRDVVIFYQRKLKSQKSLVSFCEFENKEIEIKKEDGTSTKKVIGLKVAPKSSPLFQEFKIWQNLNNVLIRKKGSKTKKAAKNQQAVLFEEEKTISELDLEAKQALFNELNLKGNLKADYCLEILGYSPKEWEMNYSVLEGNRTNKALYEAYLKITDLEGYDAKNHLKVKLNKDEVELDDLKVPASEIKEMVQAIFKEAGINTDILHFNAELDGKDFENQASYQLWHLLYSYEGDDSKSGNELLYKLLETKFGFKKEYAQILANVSLSDDYGNLSTKAMRKIYPYIKENKFSTACELAGYRHSKHSLTKEENDNRVLKDSLEVLKKNSLRQPVVEKILNQMINLVNALLKKYRTENPNFKFDEIRIELARELKKNAEERANMTANINKAKTEHEKIIKILKNEFGLPNPTRNDIIRYRLYEELKANGYKDLYTNIKIPQEKLFTKEIDIEHIIPKSRVFDDSFSNKTLSFRKTNLDKGERTAFDYMESKFGADKLEEYVARVEDLYKNNIISKAKYQKLLKKESEIGDGFVERDLRETQYIAKKAKEILLQITRNVLSTSGGITDRLREDWDLVNVMKELNLPKYRALGLTEMEDRKYGQQVEVIIDWTKRNDHRHHAMDALTVAFTKHNHIQYLNYLNARKNEKHREHSNIMGIQQLETIKVTDKNGNEKRVFKAPMPNFRQVTKAFLENVLISHKAKNKVVTKNKNKVAGSNKVQEVLTPRGQLHKETVYGKYQYYVQKEEKIGGKFDLETIKKVANPLYQSLLKKRLEENGGDPKKAFTGKNSLAKNPIYLDDAQTEQLPEKVKLVWLENSFSIRKDITPENFKDEKLIDKILDEGVKRILKERLQSFGNDAKKAFSDLDKNPIWLNKEKGITIKRVTISGVANAEPLHTKKDHLGKEILDKEGKPIPVDFISTGSNHHVAVYRDEKGNLQEKVVSVFEAVVRANQGLPIIDKTYNEHLGWEFLFTMKQNEMFVFPNESTGFNPNDIDLLDPKNKRIISPNLFRVQTISVVKYGNAIVRDFKFRHHLETTVEDKKELQGKTYQQIKSLSPLNDIIKVRINHLGDIVSVGEY

SEQ ID NO: 1236 - protein, 1430 aa, Artificial Sequence
  Cas9
MAQKYILGLDLGTNSIGWAVVKEAENDNEQSEIVDVGVRVNPLTTDEKTNFEKGKPISTNADRTLKRGARRNLQRYKLRRKELIKILKEHQLISDDTILAENGKGTTYQTLKLRAKSSKEKISLEELARVFLTINKKRGYKSSRKTKNEDEGQLIDGMEIAKRLYEENLTTGQLSLQLLKEGKKSLPDYYRSDLELELDKVWNFQKQFHSDILTDEFYTQLKGKGQRATSALFLEKYQIYTVENKGNREEKNLQAYQWRVDALSKELTREELAFVITEINNNLNNSSGYLGAISDRSKELYFNNETVGEYLWKQIAANPHTSLKNQVFYRQDYLDEFERIWNTQAQFYPQILTESLKKELRDVVIFYQRKLKSQKSLVSFCEFENKEIEIKNEDGTTTKKVIGLKVAPKSSPLFQEFKIWQNLNNVLIRKKGSKTEKVAKNQQVVLFEEEKTISELDLEAKQALFNELNLKGNLKADYCLEILGYSSKEWEMNYSVLEGNRTNKALYEAYLKITDLEGYDAKNYLKVKSNKDEVELDDLKVPASEIKEMVQAIFKEAGINTDILHFDAELDGKDFENQGSYKLWHLLYSYEGDDSKSGNELLYKLLETKFGLKKEYAQILANISLSDDYGNLSTKAMRKIHPYIKENKFSTACELAGYRHSKHSLTKEENEKRVLKDGLEVLKKNSLRQPVVEKILNQMINLVNALLKKYRTENPNFKFDEIRIELARELKKNAEERANMTANINKAKTEHEKIDKILKSEFGLPNPTRNDIIRYRLYEELKANGYKDLYTNRYISSEKLFSKEIDIEHIIPKSRVFDDSFSNKTIVYRTDNLDKGEQTAYDYIESKFGAEKLKEYMTRVKDLYQKKIISKAKYQKLLKKESEIGDGFVERDLRETQYIAKKAKEILLQITHNVLSTSGGITDRLRKDWGLVNVMKELNLPKYRALGLTKMEDRKYGQQVEVITDWTKRNDLRHHAMDALTVAFTKHNHIQYLNYLNARKNEKHKEHNNIMAIQQLETIKVTDENGNEKRIFKAPMPNFRQVAKTFLENVLISHKAKNKVVTKNKNKISGSNKVQEVLTPRGQLHKETVYGKYQYYVQKEEKIGAKFDSETIEKVANPLYQSLLKKRLEENGGDPKKAFTGKNSLAKNPIYLDDTQTEQLPEKVKLVWLENSFSIRKDITPENFKDEKLIDKILDEGVKRILKERLQSFGNDAKKAFSDLEKNPIWLNKEKGIAIKRVTISGVANAEPLHTKKDHLGKEILDKEGKPIPVDFISTGNNHHVAVYRDEKGNLQEKVLSVFEAVVRANQGLPIIEKTYNQHLGWEFLFSMKQNEMFVFPNESTGFNPNDIDLLDPKNKRIISPNLFKVQKLATKNYMFTHHLETKSIDGDMLKNKKELSGILYNFIQTPQKLYGIIKVRINHLGDIVSVGEY

SEQ ID NO: 1237 - protein, 1431 aa, Artificial Sequence
  Cas9
MKRILGLDLGSSSIGWALVNEAESKNERSSIVKLGVRVNPLTVDESINFEKGKSITTNADRTLKRSMRRNLHRYKLRREALIEVLKECKFITEDTILSENGNRTTFETYRLRVKALTEEISLEEFARVLIMINKKRGYKSSRKAGGAEEDTLIDGMDIARKLYDANLTPGELCLQLLSAGKKVLPDFYRSDLQNELDRIWEKQKEYYPGILTAALKEELRGKKRDAVWAICANAFVWKETYTEWNNEESKNEQIEKEHKLEGIYSKRKRDEAKKENLQWRVSGLKEKLSLEQLVIILQEINTQINNSSGYLGTISDRSKELYFNKQTVGQYLMDILDNNPNASLRNIVFYRQDYLDEFNVLWEKQAEFHKELTGELKKEIRDIIIFYQRRLKSQKGLISFCEFESRQIEVKIDGKRKIRTVGNRVIPRSSPLFQEFKIWQILNNIEVTAVGNKNKQRMQNGSNEPDDTEQLELNGRRYLYQEEKELLAKELFVRDKMTKLDVLRLLFDNPEELDLNFKTIDGNKTGYLFFQAYSKMIEMSGHEPVDFKKPIEKIVEQVKSVFVLLNWNTDILSFDSNKELDKQSYYKLWHLLYSFEGDNTPTGNGCLVQKIMDSYGLGKEFAKILANITFQEDYGSLSAKAIHKILPHLKEGNQYDVACEYAGYRHSKSSLTKEEIANKVLKDKLEVLPRNSLRNPVVEKILNQMVNVINAIIEAYGRPDEIRVELARELKKNAKEREKLTKSIAETTKTHEAHKKLLQEEFGLKNVGRSDILRYKLYKELESRGYKTLYSNTYIPREKLFSKEFDIEHIIPQARLFDDSFSNKTLEARNVNIEKGNRTAYDFVKEKFGESGTDNSLDCYLNNIEVLFVSGKISKTKYTKLKMTEQDIPGGFIERDLRNTQYIAKKALSMLNEISRCVVATSGSITDKLREDWQLVDVMKELNWEKYKALGLVEYFEDKDGKQIGRIKDWSKRNDHRHHAMDALTVAFTKEVFIQYFNNKNASLNPNTNEYAIKNKYFQNGRAIAPIPLNEFRAEAKKHLENTLISIKAKNKVITNNINKTKKRGGVNTKKQQTPRGQLHLETIYGCCRQYLTKEEKVNASFDVSKIATVSSSVYRDALLKRLQEHHNDPKKAFAGRNSLDKKPVWLDKEQIRKVPEKVKTVTFETIYTIRKEISPDLRVDKIIDSGVRKMLTGRLKEYGNDAKKAFSNLDEKPIWLNKEKGIPIKRVTISGISNAQSLHVKKDKDGKPVLDGNGRNIPVDFVNTGNNHHVAVYRRPVIDKNGQMVIDENGNLKYELEEVVVTFFDAVTRVNLGQPIIDKDYKASEGWQFLFSMKQNEYFVFPNKKTGFNPKEIDLLDADNYGLISPNLFRVQKFTHKNYVFRHHLETTIKDTSSILRGITWIDFRSSKGLDSIVKVRVNHIGQIVSVGEY

SEQ ID NO: 1238 - protein, 1432 aa, Artificial Sequence
  Cas9
MKKILGLDLGSNSIGWALVNEAENRDEASSIIKLGVRVNPLTVDEMQNFEKGKSITTNADRTLKRSMRRNLQRYKLRRDALIKLLKKVGFIADGTILSEQGNRSTFETYRLRAKAPDEEISLQELARVLLMINKKRGYKSSRKIKEKEAGTLIDGMKVAKKLYDEDLTPGQLCLQLLESGKKSLPDFYSSDLQEEFDRIWNFQKQFNPKAFCDTAKEEIKGKNKSQTWAILAKYFIWTDEMVVWNEKESKTERVEKECKLVGLKRTVKKEEQRKENYRWRVQALTEQLDLGKVAVVLQEINGQISTSSGYLGAISDRSKVLYFNRQTVGQYQMAELEKNPNTSLRNMVFYRQDYLDEFDKIWEKQAEFHKELTVELKKEIRDIIIFYQRRLKSQKGLIGFCEFENREIMVEKNGKMQAKVVGCKVIPRSHPLFQEFKIWQTLNNVEVFAGEKKCKRKRTDAFPGLFDGTEDTLMVEGWRYLYQEEKEILAKELSVKKSLKKEYILKLLFDNPQDLDMNFEQIEGNDTGNVLFSAYSKMIEKYGYEPLDFGKSTDEIIERLQVIFTDLGWNTDLLFVDLNKEGKDLEKQPYFKLWHLLYSFEGDNTPTGNGKLVEKLMELCHVGKECALELVNISFQNDYGSLSAKAIKKILPYLKEGNRYDVACGYAGYRHSKSSLTKEEIENKVLKDKLDILPKNSLRNPVIEKILNQMVNVINAIIDTYGKPDEIRVELARELKKSAKERDELTKAIAKSTREHEEIRKVLQEEFGMINVSRNDIIRYKLYEELKDNGYKTLYSNQYIPKEKVFSKEIDIEHIIPQARLFDDSLSNKTLEYKAINIEKGNKTAYDFVKEKYGEKGLQQYLNRCESLFKGHRTKLRKLKMGQENIPEGFIDRDLRNTQYIAKKALAMLNEICRRVVATTGSITDRLREDWQLVDVLKELNLPKYETLGLVEVYEDKDGRKIKRIKDWTKRNDHRHHAMDALTVAFTKDVFIQYFNNKNAAWQADCKEHSDIIGIKTRYFENGRALPPMPLVRFRAEAKSHLETLLVSIKAKNKVVTNNVNCTKRKGGENKKLQQTPRGQLHLETIYGSHRQYVMKEEKVNASFDSSKIATVCKQAYRNALLERLAAFGNDPKKAFTGKNSLEKNPVYLDREQTARVPERVRTVELETVYTIRKPVDPNLSVDKVVDAKVRSILEQRLREYDGEAKRAFVNLDENPIWLNEEKGIAIKRVTIRGINKVQSLHGKKDKNGNLILDETGKKIPVDFVNTGNNHHVAIYRKPVLDKTGQEMLDNEGNPVYELDEVVVSFFEAVTRVNLGLPVIDKNYNKSEGWQFMFTMKQNEYFVFPNEKTGFDPKEVDLLNPENYAVISPNLFRVQKITEKDYMFRHHLETKVVDDKFLKEITWKRILTPNKLEGIVKVRVNHIGQIVSVGEY

SEQ ID NO: 1239 - protein, 1432 aa, Artificial Sequence
  Cas9
MKKILGLDLGSNSIGWALVNEAENSDEVSSIIKLGVRVNPLTVDEMQNFEKGKSITTNADRTLKRSMRRNLQRYKLRRDALIKLLKKVGFITDGTILSEQGNRTTFETYRLRAKAPDEEISLQELARVLLMINKKRGYKSSRKIKEKEAGTLIDGMEVAKKLYDEDLTPGQLCLQLLESGKKSLPDFYSSDLQEEFDRIWNFQKQFNPKAFCDTAKEEIKGKNKSQTWAILAKYFIWTDEMVVWNEKESKTERVEKECKLVGLKRTVKKEEQRKENYCWRVQALTEQLDLEKVAVVLQEINGQISTSSGYLGAISDRSKVLYFNRQTVGQYQMAELEKNPNTSLRNMVFYRQDYLDEFDKIWEKQAEFHKELTVELKKEIRDIIIFYQRRLKSQKGLIGFCEFENREIMVEKNGKMQAKVVGCKVIPRSHPLFQEFKIWQTLNNVEVFAGEKKCKRKRTDAFPGLFDGTEDTLMVEGWRYLYQEEKEILAKELSVKKSLKKEYILKLLFDNPQDLDMNFEQIEGNDTGNVLFSAYSKMIEKYGYEPLDFGKPTDKIIEQLQVIFADLGWNTDLLFVDLNKEGKDLEKQPYFKLWHLLYSFEGDNTPTGNGKLVEKLMELCHVGKECALELVNISFQNDYGSLSAKAIKKILPYLKEGNRYDVACGYAGYRHSKSSLTKEEIENKVLKDKLDILPKNSLRNPVVEKILNQMVNVINAIIDTYGKPDEIRVELARELKKSAKEREELTKAIAKSTREHEEIRKVLQEEFGMINVSRNDIIRYKLYEELKDNGYKTLYSNQYIPKEKVFSKEIDIEHIIPQARLFDDSLSNKTLEYKAINIEKGNKTAYDFVKEKYGEKGLQQYLNRCESLFKGQRTKLRKLKMGQENIPEGFIDRDLRNTQYIAKKALAMLNEICRRVVATTGSITDRLREDWQLVDVLKELNLPKYETLGLVEVYEDKDGRKIKRIKDWTKRNDHRHHAMDALTVAFTKDVFIQYFNNKNAAWQADCKEHSDIIGIKTRYFENGRSLPPMPLVRFRAEAKSHLETLLVSIKAKNKVVTNNVNCTKRKGGENKKLQQSPRGQLHLETIYGSHRQYVTKEEKVNASFDSSKIATVCKQAYRNALLERLAAFGNDPKKAFTGKNSLEKNPVYLNREQTARVPERVRTVELETVYTIRKPVDPNLSVDKVVDAKVRSILEQRLREYDGEAKRAFVNLDENPIWLNEEKGIAIKRVTIRGINKVQSLHGKKDKNGNLILDETGKKIPVDFVNTGNNHHVAIYRKPVLNKTGQEMLDNEGNPVYELDEVVVSFFEAVTRVNLGLPVIDKNYNKSEGWQFMFTMKQNEYFVFPNEKTRFDPKEVDLLNPENYAVISPNLFRVQKITEKDYMFRHHLETKVVDDKFLKEITWKRILTPNKLEGIVKVRVNHIGQIVSVGEY

SEQ ID NO: 1240 - protein, 1432 aa, Artificial Sequence
  Cas9
MKNILGLDLGTTSIGFAHIVEDENKEKSEIKELGVRIVSLTTDEQSDFEKGKSITTNANRTLKHGARLNLDRYQQRRKYLIDLLHKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTAENKGSKESVRLQAYQWRAEAVSKQLSKEEVAYVLTEINNNLNNASGYLGAISDRSKELYFNRQTVGQYLYAQLQENRHNSLKNKVFYRQDYLDEFERIWETQALFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSTKDDWSLDESPLSASEIRESVKAIFQALGICTKILYFDPLLPVKDFEEQDSYQLWHLLYSYESDDSTSGNETLYRILEKKYAFKREHARILANVALQDDYGSLSTKAIRKIYPNIKENQYSTACEMAGYKHSKLSLTTEELEARELKNIIPLLKKNALRNPVVEKILNQMINVVNALIEKNSERDAEGKITKYFHFDEIRIELARELKKNAQKRYEMTQNINKAKSEHQKISEILQKEFGIKNPTKSDIIRYRLYKELEHNGYKELYTNTYIAPDVLFSKNIDIEHIVPKARVFDDSFSNKTLAFKDFNIKKGESTAFDYITSLKNEEKLNQYLARVENAYKTKNISPAKYKNLLKKASEIGDGFINRDLRDTQYIAKKAKEILFQVTKNVLSTSGSITDRLREDWSLVDVMKELNMPKYQSLGLTEVEERKDGNKVTVIKDWTKRNDHRHHAMDALTVAFTKPSYIQYLNHLNARKDENNKNYSVILAIEKKETIKVPTNNGKNKRVFIEPIPNFRQVAKKHLEEIFISHKAKNKVVTKNTNKPAGTNKQQITLTPRGQLHKETIYGKYQYYVNKEEKVGVKFDKETIAKVSNPLYREALLKRLQANDNDPKKAFTGKNALSKNPIYLDEAKTKTLPEKVNLTYLEEDFSVRKKIVPKNPTSKEFVPNLKSIEKVVDEGVRNILIERLRVYNNDPEKAFVDLEKNPIWLNKEKGIAIKRVTISGVNNAQPLHIGKDHLGKTTLNKEGKEIPVDYVSTGNNHHVAIYRDKEGNLQEQIVSFFEAVVRTQQGLPIIDKTYKQEEGWQFLFTMKQNEMFVFPNEATGFNPAEIDLLDPKNKKQISPNLFRVQKIATKDYFFRHHLETNVETDNVLKNTTWKREGLSGLKDIVKVRINHLGDIVSIGEY

SEQ ID NO: 1241 - protein, 1433 aa, Artificial Sequence
  Cas9
MKKILGLDLGTTSIGYAQVNESEDFKDSSIERIGVRVNPLSVDEQTNFEKGKPISINADRTLKSGARRTLDRYQDRRSNLIDALVKSVIITEDTVLAEDGKNTTHSTFALRAKSASEKVEKAEFARILLAINKKRGYKSSRKTNNNDDEGQAIDGMAIAKKLYDENLTPGQLAYQLLKEGKKYLPDFYRSDLQAEFDKIWTFQKQFYPEILTDELQKELAGKGQRATSAIFWKKYDFNTAENKGTREEKKLKAYEWRSTSVDKKLQKEEVAYVITEINNNLTNSSGYLGAISDRSKELYFNKQTVGQYLFKQIQKNPHTKLKNQVFYRQDYFDEFEIIWETQAKFHPELTEELKNKIRDIIIFYQRKLKSQKGLISFCEFERKEVEIEKGGRRMKKTIGLKVAPKSSPLFQEFKIWQVLNNVLIRKKGSKKRRVKEPDQLNLVEQEQEVMFFDMQTKQTLFDELNVKGNLKAKRIIELIGQDANDWEINYSEIEGNRTNKALYDAYLKILDLEGYDTKALLDVKTSKDEVELDDINISGPEVKDLVKRIFESLEIDTQILEFDAELDGEVFEKQSSYLLWHLLYSYEGDDSPSGNEKLYKLLKQKFGFKKEHAQILASITLSDDYGSLSAKAMRKIYPYIREQTFDKAASLAGYRHSASSLTKEEIANRPLKDKLELIKKNSLRNPVVEKILNQVVNIVNSLIEANSEKDSDGNIISYFKFDEIRIELARDLKKNAKERAEMTLNINAAKIVHEKIFKLLQAEFGVKNPTRNDIIRYKLYEELKNNGYKDLYTNIYIPREILFSKQIDIEHIIPQSKMFDDSFSNKTIVFRKDNLDKGNSTAFDYIDSRFGKDKLTDFEQRIEFLFEQGKKNKEEGISKAKYQKLLKREADIGDGFIERDLRDTQYIAKKARNLLYEICRIVTPTTGSITDRLREDWDLVNIMQELNLDKFKKLGLTEMVEKKDGSFKERIVDWSKRNDHRHHAMDALTIAFTKHSHIQYLNYLNARKNENHKQHHNIIGIERKETEFVIDDLGNKKRKFHLPLPNFREEAKKHLENVLVSFKAKNKVVTKNKNKTASSKGEKIKVELTPRGQLHKETVYGKYKFYVSKEERIGGKFDQRTIERVANSTHKRLLLQRLLENDNDAKKAFTGKNALAKNPIYLDDTKTLTLPEIVKLTWLEEDYSIRKDITPENFKDIKVIDKILDEGVKRILKERLAKHNNNPKEAFSDLEKNPIWLNEKKSISIKKVKISGINNAEALHYKKNHLGIEILDDEKKRIPVDFVSTGNNHHVAIYRDEKGNLQEDVVSFFEAVARVNQNLPIIDKTLKAYLGWTFLFTMKQNEYFIFPNKQTGFNPTEIDLLDSMNNKLISPNLFRVQKFTVKDYFFRHHLETNVEDDSKLKNTTWKREGLGGIGNIVKVRINHIGQIVKIGEY

SEQ ID NO: 1242 - protein, 1434 aa, Artificial Sequence
  Cas9
MKNILGLDLGTNSIGWAYVKQAQNDSEKSEIAELGVRVNPLTVDEKTNFEKGKPISTNADRTLKRGARRNLQRYKLRRQELIELLKDYQVISDKTILAEDGKETTFETLRLRVKSAKEQVSLEELARILLMINKKRGYKSSRKAKNEDEGQLIDGMEIARRLYDENLTTGQLSLQLLKEGKKSLPDYYRSDLQHELDKVWNFQKQFHPDILTDEFYTSIQGKGQKATRESFSSKYGIDTAENKGSREEKKLQAYQWRADATHKELTKEELAFVITEINNNINNSSGYLGAISDRSKELIFANETVGEYLWKQIQNDPHTSLKNQVFYRQDYFDEFERIWETQSGFYPQILTESLKNELRDILIFYQRKLKSQKALVSICEFESKEIPLKDKQGNPISKNGIPVTKLVGPKVAPKSSPLFQEFKIWQNLNNVLVRPKGSRKRKVTTNQQSTLLEGQEPVFELNLEQKELLFEELNLKGNLKTDYCLELIGYSAKEWEMNYPTLEGNKTNKALYEAYLKIIDSEGYDAKKLLKVKTDKDDINLDDIKVSASEIKTMISDIFNELGINTKILDFDAELERKQFEAQASYRLWHLLYSYEGDDSKSGNELLYRLLEDKFGFKREHSKTLANVSLLSDYGNLSTKAIRTIYPYIKENKFSTACELAGYRHSKLSISKEENENRTLKDTLDVLKKNSLRQPVVEKILNQMINLINELIEKHSEKDEKGNIVKYFKFDEIHIELARELKKNAEERRELDSKVREGKDRNEKIITILKSEFGLPYPTKNDITRYRLYEELKDNGYKDLYTNTYIPREKLFSKEIDIEHIIPKSRLFNDSFSNKTICYRQDNLNKGERTAYDYIEGLGKTQLDEYLNRVENLYTNKFITKAKYRNLLKKESEIGDGFIERDLRETQYIAKKAKEMLLQITRHVVSTTGSITDRLRDDWELVNVMRELNLPKYKVLGLTEIQERKNGQTVEVITDWTKRNDHRHHAMDALTVAFTKHSHIQYLNFLNARKDEKHKEYSNIMGIQQLETEKTTDKDGKDRRVFKTPIPNFRQVAKEHLESILISHKTKNKVVTRATNKIAGSKKQQETLSPRGQLHKETVYGKYRRYVQKEEKIGSKFDLQTIERVANPLYKRLLTKRLEENGGDPKKAFTGKNALAKSPIYLDETQTQQLPEKVKLVWLETDFSIRKDITPDNFKDEKSIDKVLDEGIKRILKDRLKSFDGDAKRAFTDLEQNPIWLNKEKGIAIKRVTISGVSNAEPLHTKKDHLGNEIFDDTGKPIPVDYVSTGNNHHIAIYRDENGNLQEKAVSFFEAVTRANQGLPTVDKTYNQHLGWQFLFTMKQNEMFVFPNKETGFDPQEIDLLDPKNKKLISPNLFRVQKISTKNYFFRHHLETSVETHNALNGVTYKSQLGLNGITDIIKVRINHLGDIVHIGEY

SEQ ID NO: 1243 - protein, 1435 aa, Artificial Sequence
  Cas9
MLGCERKRKRREKEKMAKPKDYTIGLDIGTNSVGWVVTDDQNNILRIKGKKAIGARLFTEGKVAAERRSFRTTRRRLSRRRWRIKMLEELFDEEIAKVDPSFFARLHESWISPKDKRKRYSAIVFPSPEEDKKFHESYPTIYHLRDKLMKDDQKHDIREIYIAVHQMIKARGNFLHDESVETYRSGMSSLGGRSERNILSVQTLEELNDLFAENEGTEEVELNVASAEQINDILTGGHLNADSQKEISNLLLPSSFPSFDDKAKEKQVKKLINNVATNISKAWLGYKADFSTILNLAKVDKDQKKIFAFALQGGDEEDKVQELESLLEQSQTDIVDRLIEIRHAIVLSEIVPVGMTLSEAMIDKYDQHKEDLITLKAVIRNTKDKKKAAKLQAIYDLYVKNRHADLAKAMKLTGIKKRSELLDPEELKKGISSLLDDSPEAVEIKQRLEEKTFLPLQRSNNNGVIPNQLHQVELDEIIKKQSKYYPFLAEKNPDESEEAQKKAPTKLDALLTFRVPYYVGPMITKEEQEAQNGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAKHIGADIKVKGLSDPSKFNSTMSTYIDFKKIFGDQLNDVNRQNDFEKIIEYSTIFEDRKILEDKLRVDFAWLSEEQIKQLCRLRLQGWGRLSDKLLTRLTDADGQNVLERLWNSNDNFVQIVSDPNIKAKIEQENQKLLRDSQSDNAVESILDDAYTSPQNKKAIRQVMRVVHDIVKACDGNVPAKFAIEFARSQEDDPKRTTARVNQMQKIYDQISDEVVSQGVKEQLSGMKSLKDRYYLYFMQGGRDAYTGAKLNIDRLSDYDVDHIMPQSFVKDDSLDNRVLVARAVNNQKSDKVPALLFGNKVVADLGITVREMWDKWQKLGMISKRKLSNLLTDSDALTEYRAQGFIRRQLVETSQVIKLTATILQSEFPDSKIIEVPAKYNSIVRKQFDLYKSREVNDFHHAIDAYLSTIVGNYLYQVYPNLRRMFVYGEFKKFSSNAEESAHDVARRVKSMNFLDDLLRGTHGDNIYCRSTGEIVFNRNDIISKLKQAYSFKQMLVTQEVFTKKSALFNQTVYPSPKRDGSKRSGLIPRKRGMDPEIYGGYAHNQDSYFVLAKIEKVKGYTLQIVGVPIRSLEIINKAEDFSTALLDIIKSKVMYNEKTGQPKRGIKNVEILVNKLPYRQPILEKDVSYMLGSSAYKYNIKQITLSRQSMKYILDYIDDPNFTKHEMTMIDEQNERECLLSVYDEILEKVDKYLPLFDGNKFREKLHSARKEFVSLSVDDEASAIEKILRGLHANSEMPSLENLKIKPALGFFQMKNGITLSNDAVLLYQSPTGLFERRVKVSDLLK

SEQ ID NO: 1244 - protein, 1435 aa, Artificial Sequence
  Cas9
MKNILGLDLGTTSIGFAHIVEDENKEKSEIKELGVRIVPLTTDEQSDFEKGKSITTNANRTLKHGARLNLDRYQQRRKYLIDLLQKANLITSSSILAENGKNTTHSTWQLRAKAVTERIEKEEFARVLLAINKKRGYKSSRKAKTEDEGQAIDGMAIAKRLYDENLTTGQLSLQLLQQNKKLLPDFYRSDLQKEFDLVWNFQKQFYPDILTDSFYKELQGKGKDATSKAFSKRYHFDTAENKGSKESVRLQAYQWRVEAISKQLSKEEVAYVLTEINNNLNNASGYLGAISDRSKELYFNRQTVGQYLYAQLQENRHNSLKNKVFYRQDYLDEFERIWETQASFHKELTEELKKQIRDVVIFYQRKPKSQKGLISFCEFESKEIEIEKDGKTITKTIGARVVPKSSPLFQEFKIWQILNNVICKRKGIRKKKVSAKTTQLDLLNESSQTIFSLDMECKQLLFEELNLKGDLKSDKVLKLLGYSPQEWEINYNQLEGNRTQKALYEAYLKIVEMEAHDVKDILQIKSAKDDWSLDESPLSASEIRESVKAIFQALGICTKILYFDPLLPVKEFEKQDSYQLWHLLYSYESDDSTSGNETLYRILEKKYAFKREHVRILANVALQDDYGSLSTKAIRKIYPNIKENQYSIACEMAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKQFGIKNPTKSDIIRYRLYQELEHNGYKELYTNAYIAPDVLFSKNIDIEHIVPKARVFDDSFSNKTLAFREFNIKKGESTAFDYITSLNSEEELNQYLTRVENAYKTKSISPTKYKNLLKKASEIGDDFINRDLRDTQYIAKKAKEILFQVTKNVLSTSGSITDRLREDWGLVDVMKELNMPKYQSLGLTEVEERKDGNKVTVIKNWTKRNDHRHHAMDALTVAFTKPSYIQYLNHLNARKDENNKNYSVILAIEEKETIKVRTNNGKNKRVFIEPIPNFRQVAKKHLEEIFISHKTKNKVVTKNVNKPAGTDKQQITLTPRGQLHKETIYGKYQYYVNKEEKIGVKFDKETIAKVSNPLYREALLKRLQANDNDPKKAFTGKNALSKKPIYLDESKTKTLPEKVNLTYLEEDFSIRKDISPDNFKDLKSIEKVIDQGVKRILIKRLQAYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFDAVVRAQQGLPIIDKTYKQAEGWQFMFTMKQNEMFVFPNETTGFNPAEIDLLDPKNKKLISPNLFRVQTISVVKYGNSVVRDFKFRHHLETTLQDDKILQGITFQQIKSLEPLRNIVKVRINHLGDIVSIGEY

SEQ ID NO: 1245 - protein, 1435 aa, Artificial Sequence
  Cas9
MKNILGLDLGTTSIGFAHIVEDENKEKSEIKELGVRIVSLATDEQSDFEKGKSISTNANRTLKHGARLNLDRYQQRRKFLIDLLQKANLITSASILAENGKNTTHSTWQLRAKAVTERIEKEEFARVLLAINKKRGYKNSRKTKTEDEGQAIDGMAIAKCLYDENLTPGQLSLQLLQQNKKLLPDFYRSDLQKEFDLVWNLQKQFYPDILTDSFYKELQGKGKDATSKAFSKRYHFDTAENKGSKESVRLQAYQWRAEAISKQLSKEEVAYVLTEINNNLNNSSGYLGAISDRSKELYFNRQTVGQYLYAQLQENRHNSLKNKVFYRQDYLDEFERIWETQASFHKELTDELKKQIRDVVIFYQRKLKSQKGLVSFCEFESKEIEIEKDGKAITKSIGARVVPKSSPLFQEFKIWQILNNVTCKRKGIRKKKSSAKSTELDLFNEPSQSIFSLDMECKQLLFDELNLKGDLKSDKVLKLLGYSPQEWEINYNQLEGNRTQKSLYEAYLKIIEIEGYEVKDILQIKSTKDDWSLDESPLSASEIRERVKVIFQTLGICTKILYFDPLLPVKEFEQQYSYQLWHLLYSYESDDSTSGNETLYRILEKKYAFKREHATILANVALQDDYGSLSTKAIRKIYPYIKENQYSTACELAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISEKLQKQFGIKNPTKSDIIRYRLYQELEHNGYKELYTNTYIAPDVLFSKNIDIEHIVPKARVFDDSFSNKTLAFKEFNIKKGESTAFDYITSLNCEGELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKDGNKVTVIKDWTKRNDHRHHAMDALTVAFTKPSYIQYLNHLNARKDENNKNYSVILAIEKKETIKVPINNGKNKRVFIEPILNFRQVAKKHLEEIFISHKAKNKVVTKNINKPAGTDKQQITLTPRGQLHKETIYGKYQYYVNKEEKVGVKFDERTITKVSNPLYREALLKRLQANDNDPKKAFAGKNALSKNPIYLDEAKTKTLPEKVNLTYLEEDFSIRKDISPDNFKDLKSIEKVIDQGVKRILIKRLQAYDNDPKKAFVDLEKNPIWLNKEKGIAIKRVTISGVSNAQPLHIGKDHLGKTTLNKEGKEVPVDYVSTGNNHHVAIYRDKEGNLQEQIVSFFEAVVRAQQGLPIIDKNYKQAEGWQFMFTMKQNEMFVFPNEATGFNPAEIDLLDPKNKKLISPNLFRVQTISIVKYGNSVVRDFKFRHHLETTLQDDKILQGITFQQIKSLEPLRNIVKVRINHLGDIVNIGEY

SEQ ID NO: 1246 - protein, 1436 aa, Artificial Sequence
  Cas9
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFVRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNNTAYDFVKEKFGESGADNSLEQYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDENPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGQPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 1247 - protein, 1436 aa, Artificial Sequence
  Cas9
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 1248 - protein, 1436 aa, Artificial Sequence
  Cas9
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKLAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDENPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGQPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 1249 - protein, 1436 aa, Artificial Sequence
  Cas9
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKETYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSAIFEELNDAEQLELNGSRRLCQEEKELLAQELFVRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKANEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAKQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEERVNASFDMRKIETVSKSAYRDALLKRLYENDNDPKKAFAGKNSLDKQPIWLDKEQKRKVPEKVKIVTLEAIYTIRKEISPDLKVDKVIDVGVRKILIDRLNEYGNDAKKAFSNLDENPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGQPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 1250 - protein, 1436 aa, Artificial Sequence
  Cas9
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKETYTEWNKEKGKTEQQEKEHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKLAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDENPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGQPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 1251 - protein, 1436 aa, Artificial Sequence
  Cas9
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISSDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 1252 - protein, 1436 aa, Artificial Sequence
  Cas9
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQCQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 1253 - protein, 1436 aa, Artificial Sequence
  Cas9
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKETYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSAIFEELNDAEQLELNGSRRLCQEEKELLAQELFVRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKANEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIETVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKIGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 1254 - protein, 1436 aa, Artificial Sequence
  Cas9
MKRILGLDLGTNSIGWALVDEAENKDERSSIVKLGVRVNPLTVDELTNFEKGKSITTNADRTLKRGMRRNLQRYKLRRETLMEVLKEHKLITEDTILSENGNRTTFETYRLRAKAATEKISLEEFARVLLMINKKRGYKSCRKAKGAEEGTLIDGMDIARELYNNNLTPGELCLQLLDAGKKYLPDFYRSDLQNELDRIWEKQKEYYPEILTEVLKEELRGKKRDAVWAICAKSFVWEEYYTEWNKEKGKTEQQEREHKLEGIYSKRKRDEAKRENLQWRVNGLKEKLSLEQLVIVLQEMNIQINNSSGYLGAISDRSKELYFNKQTVGQYQMEMLDKNPNASLRNMVFYRQDYLDEFNTLWEKQAEYHKELTGELKKEIRDIVIFYQRRLKSQKGLVGFCEFESRQIEVEIDGKKKIKTVGNRVIPRSSPLFQEFKIWQILNNIEVTVVGKKGKRRKQKDNSPTLFDGLDDTEQLELNGSRYLYQEEKELLAQELFVRDKMTKSDVLKLLFDNPQELDLNFKTIDGNKTGYTLFQAYSKMIEMSGHEPVDFKKTVEKVVEHVKAVFDLLNWNTDILGFNSNEELDNQSYYKLWHLLYSFEGDNTPTGNARLVQKITELYGFEKEYAIILANVTFQDDYGSLSAKAIHKILPHLKEGNRYDVACAYAGYKHSESSLTKEEIANKALKDRLTLLPKNNLRNPVVEKILNQMVNVINAIIDTYGKPDEIRVELARELKKNAKEREELTKFIAETTRKHEEFKILLQSEFGLTNVSRTDILRYKLYKELESCGYKTLYSNTYIPREKLFSKEFDIEHIIPQARLFDDSFSNKTLEARSINLEKGNKTAYDFVKEKFGESGADNSLDHYLNNIEDLFKSGKISKTKYNKLKMAEQDIPDGFINRDLRNTQYIAKKALSMLNEISRRVVATSGTITDKLRQDWQLVDVMKELNWEKYKALGLVEYFEDKDGRQIGRIKDWTKRNDHRHHAMDALTVAFTKDIFIQYFNNKNASLNSNTNEYAIKNKYFQNGRAIAPIPLREFRVEAKKHLENTLISIKAKNKVVTGNINKTKKRGGVNKYLQQTPRGQLHLETIYGSGKQYLTKEEKVNASFDMKKIATVSKSAYRDVLLKRLHENDNDPKKAFTGKNSLDKQPIWLDKEQTRKVPEKVKTVTLETIYTVRKEISPDLKVDKVIDAGVRKILTGRLNEYGNDAKKAFSNLDENPIWLNKEKGISIKRVTISGISNAQSLHVKKDKDGKPILDEDSRNIPVDFVNTGNNHHVAVYRRPVIDKRGQLVIDEAGNPKYELEEVVVSFFEAVTRANLGQPIIDKDYKTSEGWQFLFSMKQNEYFVFPNEKTGFNPKEIDLLDAENYGVISPNLFRVQKFAHKNYVFRHHLETTIKDTSSILKGITWIDFRSSKGLDAIVKVRVNHIGQIVSVGEY

SEQ ID NO: 1255 - protein, 1436 aa, Artificial Sequence
  Cas9
MKYIKYILGLDIGSNSIGWALIQLDLLQKTKRIIAAGSRIIPMDQKVLSDFGKGITISPTAQRTSYRNARHCRERHLLRRERLHRVLHILGFLPTHYDKQIDFSKRYGKFVDNTEPKIAYNEGKFLFMDSFQEMLSDFKSHQPDLFYTKKNGEESKIPYDWTIYYLRKKALSQKISKEELAWIILNFNQKRGYYQLREEEGNKENDFEIISSKIISVIKKDKDKKYNKYWYDIILENGLVYQAAFYNDFVYNWINQDREFIIERTSLKNGAEKVKLSYLPTFDEIDKMDKKEQDKYYKKIKIKTENSIGNKTVGCYIYDHILQNPNEKIKGKLVRTIERKYYKEELKAILEKQIALQPELFTDQLLADCIRELYSKNEAQQRNLAARDFVHLLVEDIIFYQRPLRRQKSTLANCSLESRSYIDKDSHTRKEAPLKVCPKSNPYYQEFRVLQWLQNLKIYEIDSDQEVTHQFIKTLEDKQQLFEFLMAQKEIDCEELLKYFLNQTYPNAKEKALKSELKKWKDTYRWNYVYDIGEKSSKKYPMNETRYELKRHLEKVANLPDDFLSSEVEYLLWHLIYSVKDKVAYEKGLKKFAQKHHLDKDSFVESFKKFNPYPSEYGSFSEKAIRKLLPLMRFGAHWDFNHIDKNTQKRIEDLITGVENEEIRTILREKAEKYQLEKETDFQDLPLWLAQYIVYNRHAEASSLEKWTSVNDLETYLNEFKQHSLRNPIVEQVVMETLRVVRDIWQQYGQGQASFFNEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSKENKTIKIFTEEQYRTFIKEHYSNNPEKTKKLLLEEIPEKMVARQMNDTCYISKFISEILSKIVRSDEQDEGVHSKNVILCTGKITSILRQDWGLNDIWDNLILPRFERMNNLLQKEKFTIYSIEKQKKIPVVPINDQFKSFQKKRIDHRHHAMDAIIIACTTREHINYINNQHALEKEKDKKEKQEERDKLREKLCIKKYNNRSEGNYSWIFKKPWDTFTQEVRVALEDIVVSFKQNLRVINKATNYYERWVEENGKYIKKMVKQEGTNWAIRKPLHEETISGKIYLDREKITKNDILTATRKTVDSSFDDKRIKKITDTGIQKILLNYLKYKGSPEIAFSPEGLEELNKNLSIYNDGKPHKPIYKVRIYEKGSGRFALGEKGRKYKKYVQGASNLYFGIYQGAKRSFATIPLNEVIERQKQGLPSVPEYNEKGDLLLFSLSPNDLVYVPIEGEIIENIDFRNLSKEQKERIYNVNDFSSTCYFTPNRIAKAIFPKEVDLQRKGDKLSGSYDTKTASLEGIQIKEVCIKLKVDRLGNISKA

SEQ ID NO: 1256 - protein, 1437 aa, Artificial Sequence
  Cas9
MKYIKYILGLDIGSNSIGWALIQLDLLQKTKRIIATGSRIIPMDQKVLSDFGKGITISPTAQRTSYRNARHCRERHLLRRERLHRVLHILGFLPTHYDKQIDFSKRYGKFVDNTEPKIAYNERKFLFMDSFQEMLADFKIHQPDLFYTKKNGEESKIPYDWTIYYLRKKALSRKISKEELAWIILNFNQKRGYYQLREEEEENKENDFEIISSKIISVIKKDKDKKYNKYWYDIILENGLVYQAAFYNDFVYNWINQDREFIIERISLKNGTEKVKLSYLPTFDEIDKMDKKEQDKYYKKIKIKTENSIGNKTVGCYIYDHILQNPNEKIKGKLVRTIERKYYKEELKAILEKQVALQPELFTDQLFADCIRELYSKNEAQQRNLAARDFVHLFVEDIIFYQRSLRRQKSTLANCSLESRSYIDKDSHTRKEAPLKVCPKSNPYYQEFRVLQWLQNLKIYEIDTDQEVTHEFIKTLEDKQQFFDFLMNQKEIDCEELLKYFLNQTYPNAREKALKSELKKWKDTYRWNYVYDIGEKSSKKYPMNETRYELKRHLEKVANLPDDFLSSEVEYLLWHLIYSVKDKVAYEKGLKTFAQKHHLDKDSFVESFKKFKPYPSEYGSFSEKAIRKLLPLMRFGSYWDFNHIDKNTQKRIEDLITGVENEEIRTILREKAEKYQLEKETDFQDLPLWLAQYIVYNRHAEASSLEKWTSVNDLETYLNEFKQYSLRNPIVEQVVMETLRVVRDIWQQYGQGQASFFDEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSTENKTIKIFTEEQYRTFIKEHYSNNPEKTKKLLLEEIPEKMVARQMNDTCYISKFISEILSKIVRSDEQDEGVHSKNVILCTGKITSALKQDWGVNDVWNDLILPRFERMNDLTQSTLFTTYNEKYQKYLPTVPMEYSNGFQKKRIDHRHHAMDAIIIACATREHINYINNQHALEKGKDKKEKQKEHDKLREKLCIKKDNKGSEENYSWIFKKPWDTFTQEVQAALEGIVVSFKQNLRVINKATNYYERWVEENGKYIKKMVKQEGTNWAIRKPLHEETISGKIYLDREEITKNDILTATRKTVDSSFDEKRIKKITDTGIQKILLNYLKYKGSPEIAFSPEGLEELNKNLSIYNDGKPHKPIYKVRIYEKGSGRFALGEKGRKYKKYVQGAPNLYFGIYQGANKRSFATIPLNEVIERQKQGRPSIPEYNEKGDPLLFSLSPNDLVYVPVEGEIIEDIDFQNLSKEQKERIYNVNDFSSTCYFTPNRIAKAIFPKEVDLQRKGDKLPGSYDTKTASLEGIQIKEVCIKLKIDRLGNISKA

SEQ ID NO: 1257 - protein, 1438 aa, Artificial Sequence
  Cas9
MKTILGLDLGTNSIGWALIKQNFENKYGEILGMGSRIIPMSQDILGEFGKGNSVSQTAARTDYRATRRLRERFLLRRERLHRVLNVLNFLPEHYASQIDFDKRFGKFKVETEPKLAWKNIDGKFSFLFQTSFNEMLEDFKAHGQDLKVPYDWTIYYLRKKALSQKIEKEELVWILLNFNQKRGYYQLRGEEEEENPNKLIEFYSLKIIDVLADEPQKGKSDIWYSLVLENGWIYRRSSKTSLLDWKDKIRDFIVTTDLNDDGSVKTDKEGNEKRSFRAPGENDWTLVKTKTEQEIDRSRKTVGNYIYETLLQNPKQKIKGKLVRTIERKFYKEELKRILEKQKEFHRELESNDLYNDCIRELYRNNEAHQLTLSKKDFVHLFMEDIIFYQRPLKSQKSSISNCTLEFRKYKDENGIEHTQFLKAIPKSNPYYQEFRIWQWIFNLNIYKKDNDDNVTKEFLNTTRDFENLFEFLNNRKEIEQKPLLKFLLEQKEFKGKLLNAETEKFRWNYVEDKKYPCNETRTMISERLKKVENISDDFLTREMEQKIWHIIYSVNDKTEYEKALKSFAEKNNLDENSLFEAFKKLPPFKSEYGSFSEKAIKKLLPLMRLGKYWSYAKIDLYSKNRIQKIITGEFDENIKDRVREKAIRLTAENDFQGLQLWLAQYIVYGRHSEASMIGKWNSADDLEEFLKEFKQHSLRNPIVEQVITETLRIVKDIWLKYGNGAKDFFNEIHIELGREMKQTKDERANATKTITENENTNLRIKALLAEMMNDHSVENVRPYSPMQQEILKIYEDGILKSDIEIDDDILKISKTAQPSSSDLKRYKLWLEQKYKSPYTGQIIPLNKLFTPEYEIEHIIPQSRYFDDSFSNKIICESAVNKLKDNYIGLGFIKQFGGTIIECGFGKRVKVFEVGEYEEFVKKHYANNRGKRNKLLLEEIPEKMIERQMNDTRHISKYISGILSHIVRVEDGTDEGVNSKNVIPGNGKITTQLRQDWGLNDVWNELILPRFERMNQLTNSTDFTSWNENHQKYLPTVPVEFSKGFSKKRIDHRHHALDALVIACATKDHVNLLNNQSAKSATKRYDLKKKLMKFEKTVYKDPQTEKRIEREVPKHFLKPWETFTVDAKNRLETIIVSFKQNLRVINKATNYYEKYVEKDGVMMKERVEQTGTNWAIRKPMHKETVSGKIDLPWVKVPKGKILTATRKSLDTSFDLKAIASITDTGIQKILKNYLEFKESPELAFSPEGIEDMNKNIEKYNGGRPHQPISKVRVFELGSKFQVGQTGNKKDKYVEAAKGTNLFFAIYEDKKGKRSYETIPLNEVIERQKQGLSVVDLKNVNDFFLCPNDLVYIPSGDEFENRGSIEIENITKEKSERFYKVVSFSGSQIFFVRHDIAVSIVNKGEFSTLNKMERAIDGSMVKEICIKLKIDRLGDVLKA

SEQ ID NO: 1258 - protein, 1438 aa, Artificial Sequence
  Cas9
MVKKGYTIGLDIGTTSVGWAVTDDDFELVNKKMSIKDKSGSTIKRVRKNLWGVRLFDEAKTAENTRRTRGVRRRIRRRKERLNYLQGIFSSEMAKMDENFFMRLEESFFKLSDKSEQNKFPYALFKNEIEEKAYYRQFPTIYHLRKHLMEHEESDLRKIYLGLHHILKYRGHFVQEGQKMDVANIDIQGNLKELFNALNENFSNKEDDFEQERMKDGVKRAKVLFDTEKLAAVEEILKEKISKSWKVNKISKGILAEKKDLPIFKAIVGNKIDLAGIFDCPDYAEKVNESIKELKDKVYFNKEDFEETFEKLSQLLKEEELEILILARKCYEAVLLADIMQGEQSLSDAMVAKYNDHKKDLVIFKKFVIDYFSEDVYFDLFKNTQLAGNYHSYVKGERKGNKFNHASLDDFYKFVKKELDKKAEELSEHPVYKQILQKIELETFLPKQRMFKNGAIPYQVHLHELRAIIKKQEKRFPFLAEKIIIKDNQKDISEYKIETLMKFRIPYYVGPLIEAREGELGKKRTNYSRFAWMQKSPESQNIGITPWNFHSVVDKDASASEFIERMTGFCSYFPEEPVLPKNSLIYQQFTVFQELSIVGYYDEQNRKHYLDGETRRRIFEDLFKKNRTVSAGLLRKWLVCNQRTSQEEKEIRLFGLDLKKNGLGSGNFNTKYTTYLDLKDAGITEKQLKQHKDFFEKIVKYQTIFEDKKILKRRIILLNEEQPLLSEEQIKNLAKKHYTGWGNLSLKLIDGIQDKGKTILDYLETQDYNQNLMQLMNDENKSFEMQIEQARAGKVQFGKIDYSFVEQLAGSPAIKRGIWQSLQIVEELVAFLGKENIKKIVIEMARENQSSKRTKSRQKQIEALYQKVTGDLKNEQEKIDVMQNFDNERVFLYYLQNGKCMHSGEKLELSQLSEYEIDHIIPQTYIKDDSFDNKVLVTRNANQQKGGDVPSYDVIDKMKSYWEKLKENNLISEKKFANLTKGKFDDQQLSGFINRQLVETRQITKNVAIILDKIYNDEAKNEKEVAIITLKSALTSQYRQGIIYVPNDDFDELKLVSKTNSRLKEVKLHDGFYKVREINDYHHAHDAYLNNVVATYLYEAMPDLRPLFVYGEHSREIHKRFLGKYATTRKGQFKQLLVDMQDEYWMRKDKEGNFIDGEILWRRDEVLQIVKKVLDYRNIQITKKLEMMVTGGEEKSFYQDSRCRKDKTAIPYKTNWDPSKYGGFKSPRTAYAIPVIKKNKPKLEPVLLVNRSKVETDGQFDCEKFKELNPTLKILGQPIWKYQSFEMFDGTKRYIASASEIHKGNQIKFSQEHMKFISCCQKYDEVKNKLAFDFVNESKHLFQEILTAIKDNIHRYRLIAEGIEVHRKFSNMLENIEKLSTQELVDNLLDAINITSVGTTNNAFGRVRYKGSYLNEIWSATLIHQSVTGLYETREKLI

SEQ ID NO: 1259 - protein, 1440 aa, Artificial Sequence
  Cas9
MKTILGLDLGTNSIGWALVEQDFENKQGLILGMGSRIIPMDAGIIGKFAEGSSISQTAERTGYRSIRRLRERHLLRRERLHRVLNILKFLPEHYAAEIDFEKRFGQFLAETEPKLAWKKSAEGKFEFLFQRSFDEMVADFKANGQDIKIPYDWTIYYLRKKALTQKISPQELAWIILNFNQKRGYYQLRGEEEEENPNKKVEFYSLKIVDVVADEQPNKKGDTWYSLHLENGWVYRRSSKIPLYDWKDKVRDFIVTTDINEDGSEKLDKDGEVKRSFRAPKEDDWTLIKKKTEQEIEQFNQTVGSYIYEALLDNPTQKIRGKLVRTIERKFYKSELKKILEKQIELQPELFTEDLYNACARELYRSNVAHQQQLSSRDFVYLFLNDIIFYQRPLRSQKSLISNCSLEFRTIKDKDGNGQIIYLKAIPKSNPYYQEFRVWQWLYNLKIFTKEDDKDVTNQFINKVEDLEALFEFLMNQKEVNHTDILTYLIEPIVKSKYPNAKGKAFKDELKKELKKYRWNYVYDADKDESKSYPMNETRYELRKRLDKVENVPADFMTRKIEQHLWHIIYSVTDKIEFEKALKSFANKYDLHQESFVENFKRFKPFDSDYGTYSEKAIKKLLPLMRVGKYWSWEGIDNNTKKRIGKIITGEYDETIKNRVREKAIDLTEENHFQGLQLWLAQYIVYDRHSEADIAGKWNSVADLEQYLSEFKQHSLRNPIVEQVITETLRVVRDIWKQYGKGAKDYFDEIHIELGREMKNTAEERKRLSSIISENETTNLRIRAILEELMYDENMENVRPYSPMQQEALKIYEDGVLSSSVEIPEDIEKISKKSEPTKSEIQRYKLWLEQKYRSPYTGRPIPLSKLFTPAYQIEHIIPQARFFDDGFSNKVICESEVNALKDKMLGLEFIQNYYGQKVTTSFGEVTILTEDAYKAFVKEHYDKNRSKRNKLLLEEIPEKMIDRQMNDTRYISKYISKVLSNLVRGEKDDEGVNSKNIIPGNGKISGTLKQDWGLNDVWNDLILPRFERMNQLTNSTDFTAWNEKHQKFLPTIPLELSKGFQKKRIDHRHHALDALIIACATRDHVNLLNNKHAKSRNERYDLQHKLRHTTPWQDKEGKVRTKFTEFKKPWETFTQDTKKELEKIVVSFKQNLRVINKATNYYEKIVDGKKVMFKQEGVNWAIRKPMHKETVSGKIDLPRVKVSKGKILTATRKSLDTSFNAKTILSITDTGIQKILLNYLKAKGNPELAFSPEGIEEMNQNISLYNDGKPHQPILKVRVFEQGSKFPLGETGNKTTKYVEAAKGTNLFFGVYENNQGKRSYNTIPLNLVIERQKQGLNSVPETNEKGHRLLFSLSPNDLVYVPIEGEVFDKTNPDVNRIYKIVSFSGSQMFCVRQDVATSIVYKLEFSSLNKMERTIDGIMIKEICIKLKVDRLGNISKA

SEQ ID NO: 1260 - protein, 1440 aa, Artificial Sequence
  Cas9
MKTILGLDLGTNSIGWALVEQDFENKQGLILGMGSRIIPMDAGIIGKFAEGSSISQTAERTGYRSIRRLRERHLLRRERLHRVLNILKFLPEHYAAEIDFEKRFGQFLAETEPKLAWKKNAEGKFEFLFQRSFDEMVADFKANGQDIKIPYDWTIYYLRKKALTQKISPQELAWIILNFNQKRGYYQLRGEEEEENPNKKVEFYSLKIVDVVADEQPNKKGDTWYSLHLENGWVYRRSSKIPLYDWKDKVRDFIVTTDINEDGSEKLDKDGEVKRSFRAPKEDDWTLIKKKTEQEIEQFNQTVGSYIYEALLDNPTQKIRGKLVRTIERKFYKSELKKILEKQIELQPELFTEDLYNACARELYRRNVAHQQQLSSRDFVYLFLNDIIFYQRPLRSQKSLISNCSLEFRTIKDKDGNGQIIYLKAIPKSNPYYQEFRVWQWLYNLKIFTKEDDKDVTNQFINKVEDLEALFEFLMNQKEVNHTDILTYLIEPIVKSKYPNAKGKAFKDELKKELKKYRWNYVYDADKDESKSYPMNETRYELRKRLDKVENVPADFMTRKIEQHLWHIIYSVTDKIEFEKALKSFANKYDLHQESFVENFKRFKPFDSDYGTYSEKAIKKLLPLMRVGKYWSWDIIDDKTKTRIGKIITGEYDETIKNRVREKAIDLTEENHFQGLQLWLAQYIVYDRHSEADIAGKWNSVADLEQYLSEFKQHSLRNPIVEQVITETLRVVRDIWKQYGKGAKDYFDEIHIELGREMKNTAEERKRLSSIISENETTNLRIRAILEELMYDENMENVRPYSPMQQEALKIYEDGVLSSSVEIPEDIEKISKKSEPTKSEIQRYKLWLEQKYRSPYTGRPIPLSKLFTPAYQIEHIIPQARFFDDGFSNKVICESEVNALKDKMLGLEFIQNYYGQKVTTSFGEVTILTEDAYKAFVKEHYDKNRSKRNKLLLEEIPEKMIDRQMNDTRYISKYISKVLSNLVRGEKDDEGVNSKNIIPGNGKITGILKQDWGLNDVWNDLILPRFERMNQLTNSTDFTAWNEKHQKFLPSVPLELSKGFQKKRIDHRHHALDALIIACATRDHVNLLNNKHAKSRNERYDLQHKLRHTTPWQDKEGKVRTKFTEFKKPWETFTQDTKKELEKIVVNFKQNLRVINKATNYYEKIVDGKKVMFKQEGVNWAIRKPMHKETVSGKIDLPRVKVSKGKILTATRKSLDTSFNAKTILSITDTGIQKILLNYLKAKGNPELAFSPEGIEEMNQNISLYNDGKPHQPILKVRVFEQGSKFPLGETGNKTTKYVEAAKGTNLFFGVYEDNQGKRSYDTIPLNIVIERQKQGLNSVPETNEKGHRLLFSLSPNDLVYVPIEGEVFDETNPDVNRIYKVVSFSGSQMFCVRQDVATSIVYKLEFSSLNKMERTIDGIMIKEICIKLKVDRLGNISKA

SEQ ID NO: 1261 - protein, 1443 aa, Artificial Sequence
  Cas9
MIKLLYLEKLKQYTMKKILGLDLGTSSIGWALVNEAENSDEVSSIIKLGVRVNPLTVDEMQNFEKGKSITTNADRTLKRSMRRNLQRYKLRRDALIELLKKVGFITDKTILSEQGNRTTFETYRLRAKAAEEEISLKELARVLLMINKKRGYKSSRKAKGEEEGALIDGMEIAKKLYDEDLTPGQLCLQLLESGKKFFPDFYRSDLQEEFNKIWDFQKQFNLFSFCDVAKEEVKGKNKSQTWAILAKYFVETKKVNVWNEHEAQTENREEVYKLVGLKRTVKGEELKKENYRWRVQALTEQLDLEKIAVVLQEINGQISASSGYLGAISDRSKVLYFNRQTVGQYQMAELNKNPNMSLRNMVFYRQDYLDEFNVIWEKQAEFHKELTPELKKEIRDIIIFYQRRLKSQKGLISFCEFENREVVVEKEGKKQTKIIGCKVIPRSHPLFQEFKIWQTLNNIEVFVGEKKGKRKKSNVSSDLFGDTEDALITEGRRFLYQEEKKILAKELSIKKGLTKAEILRLLFENPQELDINFKQIDGNQTGFALFSAYSNMIEKYGYEPLDFKKPAEDLISQLKTVFTDLGWNTDLLFIDLDKENKEWEKQPYFRLWHLLYSFEGDNTPTGNGKLIEKIMQLCGIEKEYAIELANVSLQDDYGSLSAKAIKKILLYLKEGNQYDMACEYAGYRHSKSSLTKEEIENKVLKDKLEILPKNSLRNPVVEKILNQMVNVINTVMEVYGRPDEIRVELARELKKSAKEREELTKAVAKNTREHEEIRKVLQSEFGMINVSRNDIIRYKLYEELKDNGYKTLYSNQYIPREKLFSKEIDIEHIIPQSRLFDDSLSNKTLEYKSINIEKGNKTAYDFVKEKYGEEGLQQYLNRCENLCKDKKAKLRKLKMELNEIPDGFIDRDLRNTQYIAKKALSMLTEICRRVVATTGSITDKLREDWQLVDVMKELNLPKYEALGLVEVYEDKDGRKIKRIKDWTKRNDHRHHAMDALTVAFTKDVFIQYFNNKNAAWESDSKEHTNIVGIKTRYFESGKAVPPIPLGQFRVEAKCHLENLLVSIKAKNKVVTTNVNCIKKKGGTYKNTQQTPRGQLHLETIYGSHNQYVTKIEKVNASFDAVKIATVSKQDYRNALLKRLEVFGNDPKKAFTGKNSLEKNPIYLDRAQTIQVPDKVQTVELETAYTIRKPVDPTLNVDKVVDKKIRLILEQRLKEYGGDAKKAFVNLDENPIWLNEEKGISIKRVTIRGISKAQALHDKKDKDGNFILDETGKRIPVDFVNTGNNHHVAIYRKPVLDKKGQVIFDDEGNPMYELDEDVVPFFEAVTRANLGIPIIDKDYKKSEGWQFLFSMKQNEYFVFPNEKTGFNPKEVDLLDPDNYAMISPNLFRVQKIGLNDYTFRHHLETTIQNDLKFITWIRCGKSGIKDIVKVRINHIGQIVSVGEY

SEQ ID NO: 1262 - protein, 1443 aa, Artificial Sequence
  Cas9
MKKILGLDLGTASIGSAYVLEAEKSADQTKIVYLGTRIILSSADAENFSKGLSCSPTTDRTFKRSMRRRLQRYKQRRSSLIQQFKKIGIITNTEQIIREPISETHELLRIRSKAVSEHVSLEEFARILLTINKRRGYKSNRKTSKSTEEDGKLVDAMAVTKELIKLKKTPGQYMFERFKRGKYAEIDFYPFDLINELKQIWEVQGQKYPDVLTEGLLSSLLKQKTGKAKELIYSKSDLNPAEVPIDYQKGKKLRKTILNKYFAYESRSLAVTNIIPVEQAITAIVAICKQINNSSGYLGAIGDRSRVLYANNQTIGQYLYERIKANPHDRIRGEVFYRQDYLDEFDRIWECQQNYYPAILTNDRKQYIRNRIIFYQRPLKSKKSELAFCEFESREVEHNGKKYTEGLHVAPKSSPVFQHFRLWQRLGQIEVSPLRKWDKQSNELFEQQNNADREGILNTEAKQKLFSYLNLLDHLTDNEILNILGYSPDKWKINFREIIGNRTNNLMMKAFFSMKEMTDGEQIDWEKNLTKITNGQSLISPEQIVDLIRQFFEREGITTSLLYFDPATDNFREQSHYSLWHLLYSYEDDNSPTGTTSLCKTLAKRYGIPHELCPLLASLTFERQYGSLSTKAMRKLLPFMQEKRYDEACELAGYRHSAWITKEENAKRTLKNKLPLLRKGSLRNPVVEKILNQMTHVINTHIAEYGNPDEIRIEMARDMQANSKQRKAMTAAITEATKRNTQFIEEIQKEFGFNPSKNDLIKYKLWKELAPLGNKTLYSNIYIPKEELFTAKFEIEHIIPRALFYDDSFSNKTLELNSVNKLKGNKTALDYLDTLGQEKANDYILRVEELKKIGAITQAKYKKLLIREKDLGDDFTNRDLTNTRYIIRHAADRDLTNTRYIIRHAADMLLQVTPSIVHTNGSITAILRRDWGLLDILKELNLPTYESIDRKISDPEEKLTQSVDRKDGQAIKMIKDWSKRDDHRHHAMDALITALTTRKHVQYLNGNSGAEETDKAQKLEQLKALRKQLIGSDGHFIPPMHDIRVQAKEALSRVIISTKVKGKVTTPNTNIICSRDKTTGRKIYVRQTTLTPRGALHLDTKYGINRYYQEREVSIGSKLTQEEIRLVSSPHIQSILLERLRAFDNNPKSAFTGRNSVDKKPLEDKNKKLVYTDKKVKQTILANRFVKRDRVNSKLDLDNVIDTGIKRILERRLKQYGGKYETAFSDLENNPIWLNEEKGIAIKSVRIRGKNNTITIRQTNTCRIKYVANDNNHHLAVYALPDGSIKDDIVSFFDAVERSRKRLPIIDKHKNQSLGWKYLFSIKQNEYFLLPQQVEKIDIDTGEISMQTTFSPKDLSHEYIMNPDNYAELASHIFRVQSISKTPQGNRDVRIYLFKQQYISGSQKDSLHLKGITHRQISSAKDLAELVKIRVNHLGRIVSVGEK

SEQ ID NO: 1263 - protein, 1446 aa, Artificial Sequence
  Cas9
MVKNILGLDLGTNSVGWALIKQDFENKQGDILGMGSRIIPMSQDVLGDFGKGNSISQTAERTKYRSVRRLRERFLLRRERLHRVLNVLDFLPEHYASQIDFNKRFGKFKEETEPKLAYSNDGFIFKKSFEEMISDFKTHQPELLENNKKVPYDWTIYYLRNKALSHKIEKEELAWILLNFNQKRGYYQLRGEEEEENPNKLIEFYSLKIVDVLADEPQKGKSDIWYSLILENGWIYRRSSKIPLLDWKGKTRDFIVTTDLNDDGSVKTDKEGNEKRSFRAPGENDWTLVKKKTEQEIDNSDKTVGAYIYEALLQNPKQKIKGKLVRTIERKFYKAELKQILEKQMEFHPELRQDDLYSDCVRELYKNNEAHQLTLSKKDFVHLFMEDIIFYQRPLRSQKSSISNCTLEFRKYKDENGTEHIQYLKALPKSNPYYQEFRIWQWMYNLNIYKKEDDTNVTKEFLNSKADFESLFEFLNNKKEVDQKALLKHFKINDKTHRWKYVEDKKYPCNETKTMISERLKKVENISDDFLTREMEQKIWHIIYSVNDKVKYEKALKSFAEKNNLDESSFFEAFKKFPPFKSEYGAFSEKAIKKLLPLMRLGKYWDDDEILKYSDIYFKNIEYLLGVLKQKDKNISDDNRQNWNKSINNKLREELEIFQNAEIESFQGLRLHIAQYILYGRHSEAAMLGKWNSADDLEEFLKEFKQHSLRNPIVEQVITETLRVVKDIWVKYGNGAKDFFNEIHIELGREMKLPAEDRKKITNQISENENTNLRIKALLAEMMVDSSVENVRPFSPMQQEILKIYEDGVLNSDIEIEDDILKISKTAQPSPSDLKRYKLWLEQKYKSPYTGQIIPLNKLFTPEYEIEHIIPQSRYFDDSFSNKVICEAAVNKLKDNFIGLGFIKQFGGTIVECGNGKSVTVLKEDQYEDFVKKHYANNRSKRNKLLLEDIPEKMIERQMNDTRYISKYISGVLSNIVRTEDGTDDGVNSKNIVPGNGKITNTLKQDWGLNDIWNDLILPRFERMNQLTNSTDFTAWNENHQKFLPTVPVEFSKGFSKKRIDHRHHALDALVIACATKDHVNLLNNQSAKSDTKRHDLKRKLMKFEKVAYNHPQTGERIEREVPKQFLKPWETFTVEAKNGLETIIVSFKQNLRVINKATNHYEKYVEKDGAKVKGRVEQAGTNWAIRKPMHKETVSGKIDLPRIKVPKGKILTATRKNLDTSFDLKTIGSITDTGIQKILKNYLQYKDNNPELAFSPEGIEDMNKNIEKFNDGKVHQPIIKVRIFELGSKFPLGQSGNKKDKYVEAAKGTNLFFAVYEDKNGKRSYETIPLNEVIERQKQGLTVVDLKGVNDFYLSPNDLVYVPSEDELENVSMIDYNKLSNEKVYKVVSFTGNQIFFVRQDVATSIVNKAEFSSLNKMERAIGGTMIKEVFVKIKIDRLGNISKV

SEQ ID NO: 1264 - protein, 1448 aa, Artificial Sequence
  Cas9
MKHILGLDLGTNSIGWAVVKEAQNDNEQSEIVDVGVRVNPLTTDEKTNFEKGKPISTNADRTLKRSARRNLQRYKLRRKELIELLKEHQLISENTILTENGKGTTFQTLELRAKSAKEKISLGELARVFLTINKKRGYKSSRKAKNGDEGQLIDGMEIAKRLYEENLTTGQLSLQLLKEGKKSLPDYYRSDLQFELDKVWNFQKQSHSDILTDEFYAQLKGKGQRATSALFLAKYQIYTAENKGSREDKKLQAYQWRVDALSKELTREELAFVITEINNNLNNSSGYLGAISDRSKELYFNNETVGEYLWKQIAANPHNSLKNQVFYRQDYLDEFEQIWKTQSAFYPEILTDELKKELRDVVIFYQRKLKSQKSLVSFCEFENKEIEIKNEDGTTTKKVIGLKVAPKSSPLFQEFKIWQNLNNVLIRKKGSKTKKVAKNQQAVLFEEEKTISELDLEAKQALFNELNLKGNLKADYCLEILGYSPKEWEMNYSILEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGNLSTKAMREIITHLKQGFPFTGRKDRPDEPSACEFAGYKHSKHSLTKEENEKRVLKDSLEVLKKNSLRQPVVEKILNQMINLVNALLKKYRTENPNFKFDEIRIELARELKKKAEERANMTANINKAKTEHEKIIKILKNEFGLPNPTRNDIIRYRLYEELKDNGYKDLYKGDYIPREKLFSKEIDIEHIIPKARVFDDSFSNKTITYRKTNLEKGERTAYDYIESLGEKQLEEFLSRIENLYEIGKPSRLHNRRNPLKKVEEKGISDSKYKKLLKKESEIGDGFVERDLRETQYIAKKAKEILLQITRSVLSTSGGITDRLREDWDLINVMKELNLPKYRALGLTKMEDRKYGQQVEVITDWTKRNDLRHHAMDALTVAFTKHNHIQYLNYLNARKNEKHKEHNNIMAIQQLETIKVTDENGNEKRIFKAPMPNFRQVAKAFLENVLISHKAKNKVVTKNKNKISGNNKVQEVLTPRGQLHKETIYGKYQYYVQKEEKIGGKFDLETIEKVANPLYQSLLKKRLEENGGDPKKAFTGKNSLAKNPIYLDEAQTEQLPEKVKLVWLENSFSIRKDITPENFKDEKLIDKILDEGVKRILKERLQSFGNDAKKAFSDLEKNPIWLNKEKGIAIKRVTISGVANAEPLHTKKDHLGKEILDKEGKPIPVDFISTGSNHHVAVYRDEKGNLQEKVVSVFEAVVRANQGLPIIDKTYNQYLGWEFLFSMKQNEMFVFPNESTGFNPNDIDLLDPKNKKIISPNLFRVQKLATGDYWFRHHLETTVETKSATKDMTYKRLSLNHIKNIIKVRINHLGDIVSVGEY

SEQ ID NO: 1265 - protein, 1450 aa, Artificial Sequence
  Cas9
MKHILGLDLGSNSIGWAFVQQDFENKQGKIIATGSRIIPMDQGILGDFERGNTVSQTAERTTYRNTRRLRERHLLRRERLHRVLHILGFLPPHYDSQIDFTKRYGKFIDNAEPKIAYNNGNFIFMNSFNEMIEDFKKYQPQLFYKKSNGEESKIPYDWTIYYLRKKALSQKITQQELAWLILHFNQKRGYYQLRGEEETENPNKEVAFHSLEVVDVEAEAPNKKGEIWYTIRLENGWIYRRTSKIPLDDWKGKTRDFIVTTDLNDDGTIKLDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTPIKVCAKSNPYYQEFRVLQWLQNLRIYEIETDREVTAEFIETAQDNEALFNFLMSQKEIDNESLLKYFLFAKNPQIKDKVAKSELKKWLTTYRWNYVYDAADNSSKKYPMNETGYELQQYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSETCFQGLPLWLAQYVVYNRHAEAADIEKWTSVNDLEAYLEDFKQHSLRNPIVEQVITETLRVVRDIWQRYGGGQANFFDEIHIELGRELKKTAEERKQLSNRNQENENTNLRIKKLLAELKEDASIQNVRPYSPVQQELLKIYEEGVFSATDEVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNELILPRFERMNQLTQTQLFTSYNDRFQKNLPTVPIEYSQGFQKKRIDHRHHAMDALVIACATREHINYMNNQHALDKSKDKKEKQQSRIDLRTILCEKKNNNWQFKKPWSTFTQEAQEALEHIVVSFKQNLRVINKATNYYEKWEEKNGVLVKKKVKQEGTNWAIRKPLHKETVSGKIVLDRKIGKDKILTATRKSVDITFTEKIISSITDTGIQKILLNYLKYKGSPEVAFSAEGLEELNKNIAQYNDGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKIEYSPLNKMERDILGTMIKEVCIKLKVDRLGNITKA

SEQ ID NO: 1266 - protein, 1450 aa, Artificial Sequence
  Cas9
MKRILGLDLGSNSIGWAFVEQDFENKQGKIIATGSRIIPMDQGILGDFEKGNTVSQTAERTTYRSMRRLRERHLLRRERLHRVLHILGFLPPHYDAQIDFTKRYGKFIDNAEPKIAYNNGNFIFMNSFNEMIEDFKKYQPQLFYKKSNGEESKIPYDWTIYYLRKKVLSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTFIKVCAKSNPYYQEFRVLQWLQNLRIYEIETDREVTAEFIETAEDYEALFNFLMSQKEIDNEGLLKYFLFAKNPQIKDKVAKSELKKWLTTYRWNYVYDAADNSSKKYPMNETGYDLQRYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSESCFQGLPLWLAQYVVYNRHAEATDIEKWTSVSDLETYLEDFKQHSLRNPIVEQVVTETLRVVRDIWQQYGGGQANFFDEIHIELGRELKKTAEERKQLSNRNQENENTNLRIKKLLAELKEDASIQNVRPYSPVQQELLKIYEEGVFSSTDQVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITGNKEVTIFTEEQYKEFVKKHYANNSAKQQKLLLNEIPEKMVARQLNDTRYISKYISEILSKIVRSDEKDEGVNSKNVIPCTGKITTALKQDWGLNDVWNELILPRFERMNQLTQTQLFTSYNDRFQKNLPTVPIEYSQGFQKKRIDHRHHAMDALVIACATREHINYMNNQHALDKNKDKKEKQQSRIDLRTILCEKKNNNWQFKKPWSTFTQETKEALEHIVVSFKQNLRVINKATNYYEKWEEKNGVLVKKKVKQEGTNWAIRKPLHKETVSGKIVLDRKIGKDKILTATRKEVDITFTEKIISSITDTGIQKILLNYLNYKGSPEVAFSAEGLEELNKNIAQYNDGKKHQPIYKVRIFEEGSKFPLGETGAKATKFVEAAKGTNLFFGVYQGKEKRSYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 1267 - protein, 1450 aa, Artificial Sequence
  Cas9
MKHILGLDLGSNSIGWAFVQQDFENKQGKIIAAGSRIIPMDQKMLSNFEEGTTVSQTAERTTYRSMRRLRERHLLRRERLHRVLHILGFLPPHYDAQIDFTKRYGKFIDNAEPKIAYNNGNFIFMNSFNEMIEDFKEHQPQLFYKKSNGEESKIPYDWTIYYLRKKALSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKLDKEGKEKRSFRAPDENDWNLLKKKTEHDIDFSGKPVGTYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTPIKVCSKSNPYYQEFRVLQWLQNLRIYEIETDREVTAEFIETAQDYEALFNFLMSQKEIDNESLLKYFLFAKNPQIKDKTAKIELKKWITTYRWNYVYDVADNSSKKYPMNETGYDLQRYMQKVEGLPTNFLTFDTTYRLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYGGGQANFFDEIHIELGRELKKTAEERKQLSDKNQENENTNLRIKKLLAELKEDASIQNVRPYSLVQQELLKIYEEGVFSSTDEIEEDIQKIRKKVEPTTPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNELILPRFERMNQLTQTQLFTSYNDRLQKNLPTVPIEYSQGFQKKRIDHRHHAMDALVIACATREHINYMNNQHALDKSKDKKEKQQSRIDLRTILCEKKNNNWQFKKPWRTFTQEAKEALEHIVVSFKQNLRVINKATNYYEKWEEKNGVLVKKKVKQEGTNWAIRKPLHEETFSGKISLNREKVGKGNILTATRKAVDSSFDVKKISKITDTGIQKILLNYLKYKGSPEVAFSAEGLEELNKNIAQYNNGKKHQPIYKVRIYEKGSGRFVLGEKGTKSKKYVQGAPNLYFGVYQGKEKRTYATIPLNEVIERQKQGLPSVPERNEKGEPLLFSLSPNDLVYVPMEGEATETINFNNLNKEQKERIYKTVSFTGNQCFFVQEAVASPIVNKMEYSPLNKMERSIVGIMIKEVCIKLKVDRLGNITKA

SEQ ID NO: 1268 - protein, 1453 aa, Artificial Sequence
  Cas9
MKTVLGLDLGTNSIGWALIQHDFDSKKGEILGMGSRIIPMSQDILGEFGKGNSVSQTADRTKFRSARRLRERHLLRRERLHRVLNILGFLPRHYAADIDFEKRLGQFFEGKEPKLAYDNNQFIFTKSFGKMLADFRQHQPDFLKDEKSNDLLIPYDWSIYYLRKEALTKKIEKEELAWIILNFNQKRGYYQLRGEEEEENLNKLVEFHSLKIIDVVADEKLNNKGETWYSLLLENGWTYRRSSKVPLFDWKEKVRDFIVTTDINDDGSVKTDKEGNEKRSFRAPSDDDWTLLKKKTEQDIDKSRKPIGAYIYDAILKNPKQKINGKLVRTVERKFYKEELKLILQKQKEFHPELQSTDLYNECIRELYKNNDAHQLQLNKKDFVHLFLEDIIFYQRPLRSQKSSVGNCPLEFRKFKDSEGIEKVEYLKTIPKSNPYFQEFRIWQWMYNLSIYKKDDDENVTRDFLKTIEDWEDLFEFLNHRKDIEQETLLKFLLGKNGVKGKALKVEAGKFRWNYVSDKIYPCNETKALIISKLEKVKGVEEKFLTEEIEYKLWHLIYSVTDKVEYEKALKAFAGKQKLDLVSFVDSFKRFPPFKNEYGAYSEKAIKKILPLLRTGKSWNWMAIDSKVRDRINKIITGEFDEEIKNKVREKAEKHSLKKENDFQGLPLWLAQYVVYGRHSEASFSGKWNSVDDLKKYLEEFKQHSLRNPIVEQVLTETLRVVADIWQFYGKGEKDFFSEIHIELGREMKNTAEDRKEMSAIIQANETTNLRIKALLNELLQDKKVENVRPYSPSQQEILKIYEDGVLSSDIEIPDDIQKISKAAQPTKSELQRYKLWLEQKYRSPYTGAMIPLGKLFTSEYEIEHIIPQSLYFDDSFSNKVICESAVNKLKDSRLGMEFIKECHGMVVETGFGKSVTVFEEETYRDFVVQNYSKNHSKKSKLLLEEIPEKMIERQMNDTRYISKFISSVLSNIVREEVNDDGVNSKNIVPGNGKITTQLKQDWGLNDIWNELILPRFERLNVLTDSKHFTAWSENHQRLLPTVPIGLSKGFSKKRIDHRHHALDALVIACASRNHINFLNNAHAIDKKKNSEEKQKFRHDLKAILCDKKYSDKSEKNYRWIFKKPWDNFTIDSKNALDKIIVSFKQNLRIINKATNRYEKWVDRDGIKVKEWHKQEGINWATRKPLHKDTVSGKVDLKRVTVPEGKILTATRKSLDTSFDLKVIESITDTGIQKILKNYLTSKSNNPELAFSSEGVEDMNKNIRKYNDGKLHQPIYKVRIFELGSKFPLGQFGNKKFKYVETAKGTNLFFAVYEDENKNRNYETIPLNVVIERQKQGLSSVPIKSEKGHKLLFYLSPNDIVYVPGSNEEFSIDRLYRFTDSSDKTANFIPLSVSSLIFSSNKNEQKKIGISYPIQDEFGLGSPQSKNQKSIDGIMIKEKCVKVNIDRLGRVSF

SEQ ID NO: 1269 - protein, 1455 aa, Artificial Sequence
  Cas9
MAKILGLDLGTNSIGWAVVEDQNNKTTLIDKGVRIFSEGVKIEKGIEKSKAAERTDFRSARKIKFRRRLRKQETLKVLIENNMCPLTIEEWTKWKKDKKEYPKNPDFINWLKTDELKNINPYFFRDKASRTELPLMQTGRALYHLAQRRGFLSNRLDQGSDGFTEQIRLDLIKKIECETDKTELLTSVQSIIDTYSEEEDKDAKKLLKGVEKLCKINNELPITEFKEKLINYLNKADNLGAVKKGIADVSKKITETGCETLGQYFYKLYQNQSKIRKVYTARTEHYYHEFLKICETQNICDQLKHKLDKAIFYQRPLKSQKGLIGKCVFEKNKTRCAVSHPAYEEYRALQFINSIKVSETKDGKKDFLSFDERKKIWPKFIRKSKPNFDFKEIAETLDKKGLSRYYNYTGHTSVSGCPTIAQLTNIFGENWQETLFEKYTNKQNTKGLKTIDEVVTDIWHVLFTFDKDEKIIEFGKQKLGLNEVLAKKFGAINLKKDYASLSLKAINKILPYLREGLIYSYAVFLANIENVVGEEIWKNDENKNLIKKELHLLIDNFNEIKGLEAVVNDFIADFKKEYNNAHKDYVLDEQDKKILLEKIESNYGKNKFESLEPDKKTEIINSTEKMVAEQLRKQRGEFIKPKRLDEKISEFLINNFNVTKKSIARLYHPSDVEIFKTASRNSEGLLLLGSPIVSSIKNPMAMRAMHQLRKLVNTLIKENIIDEETKINIELARELNDANKRAAIKKWQDERQKAREEYKKSIKELFKAECGKDIEPSDSEILKYELWEEQQHICIYTGKTINICDFIGANPNFDIEHTIPKSLCFDNSNENLTLCDIQYNRDVKRNKIPTELSDYNSIKPRLDKWLVFIDDYEKLYNTRKKAKGIETKEQKDKRIKEKHYYKLHLDYWKGKYKRFIMVDVPSGFKNSQIVDTGIITKYAISYMKSIFPKVYSVKGNIVAEFRKIWGLQNDYEKKERVNHVHHCIDAITIACMSKQKYDTLAKIYHEDEAGFHKIKKETQLVSKPWTSFTMDVLNIEKEIFVSHHTPDNMKKQSKKVVRERGIIAPKVIYETDANNNTLRDKYGKKIVKEYILLKDVNGNLIPIKGKRLTPSDIINKVDGIDYFSLIINDKIQYYEFAKSKKTGKIIYKKEPIYLQGDTVRGSLHLDTFYGAIAKDINGNIITNTNGKIAPNYVIRKELSKLKETDIENIVDPVVRGKIIEAKKNKLITFNKSGAVIKTTIWMKENQIPINKVRVYSSLKNPLPDFKKHRDLSHLTYKQQYNVSNEENYCLAIYEGKNKKGNVCRTCELVNMIDAGNYYRLSNKNWKQQYPIVPEKDSVTNYSLKTIITKGLMVLLYEKSPEEIWELTYNQQMERLYEITQLDTEKSAEIKLLFHQEAREKKVITEYMGLKTGMKGGKNIGKHKEFPWIKVGPNSFDALIEGIDFKLTPTGKIIKL

SEQ ID NO: 1270 - protein, 1457 aa, Artificial Sequence
  Cas9
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGATLKTDKEGYVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQHWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIAEMNQNISKYNDGKPHQPILKVRITEPMGAKYRVGQTGNKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGNECHFIPYYVANVIYNKGGFNMQMHRPQS

SEQ ID NO: 1271 - protein, 1457 aa, Artificial Sequence
  Cas9
MAKILGLDLGTNSIGWAIVEKNNSDFTLIDKGVRIFSEGVKTEKGIERSRAAERTGYRSARKIKYRRKLRKYETLKVLSKNRMCPLQIEDVEAWKKSGFKDYPLIPEFLQWLRTNDHENVNPYFFRDKASRAKVSLWELGRAFYHIAQRRGFLSNRLDQSSEGVLEEHNPQIQSLIEDLEETSTILNEVRDYYINLGLLDGVKGDFKKELDEGEKKLKSLYNTLIAIIKKNENDVQKCKDEIIKRLNKKEDLGKVKGKIKDISQAMLDGNFKTLGQYFYSLYNKGKIRNQYTSREEHYLQEFITICKVQGINGINDEEILPEKKFTGLAKDLYKAIFFQRPLKSQKGLIGKCSFEKNKSRCAISHPDFEEYRMWNYLNTIKFGTQSDKKLRFLTQEEKLKLIPKFYRKNDFNFEVLAKELIDKGATFGFYKSSRKNEFLYWFNYKPTDTVSACQFSASLKNAIGEDWQTKVFTYKTLNSEKKEVIRTVDYRDLWHLLSASTSDIYLYEYAKEKLGLEDKSAKTFSKIKLKKDFASLSLSAINKILPYIKEGLLYSHAVFMANIEKVVDEHIWKDVKERTIIQNEISKIIKSDVFEREVINIINGLIKNSKTEGENYAEESKNIFKTEFDNAIAKIFEKNNDIEFNQPFLDDTYLKYVEELKKFDKARSFLPVPRLDEKVIQFLLGNNKDGMVYCSDKNKTKKLYHPSDIEIFKKKIIKDEFGNEKMVLGSPLTTSIKNPMAMRALHQLRKVLNTLILEEQIDENTRIHIEMARELNDANKRKGIQDYQNENKKFREDAIKEIKKLYFEECKKEVEPTEEDVLRYQLWIEQDKKEIYEQGKSIRISDIIGSNPAYDIEHTVPRSISQNNSLMNKTLCTPRFNREIKKQKMPIELSNYEEILPRIEHWKKEAEDLTRQIESISKSIKSASTKEAKDKNIRRRHYLTLKRDYLKGKYDRFIWEEPKVGFKNSQIPDTGIITKYAQAYLKSYFKRVESVKGGMVAEFRKQWGIQESYIDENGFKHYKEKDRSKHTHHTIDAITIACMTKDKYDVLAQAWTSEDEQDKQKAKTLMSEAKPWKTFKEDIEKIEEEILVSHFTLDNVKKQSKKIVRVRGKKQYVAEIERDVNGKAMAKKDANGKIIYKLNEKGEKIPRLQQGDTIRGSLHQDSIYGAIKNPLNQEEIKYVIRKDLESLKANDVDNIVDETVKQKVKEAIENKILLLSSNAQQKNKLVDDVWLNKEKQVPIKKVRIYANSVKNPLEIKEQSLLSKSRKEHKQKVYGQNDENYAMAIYELDGKREFELINNFNLAKLIKQKEGFYPLNKEKEVKGKKVLYPIAKSNYRDVVLKRGQQVVFYDKEVENPKDISEVIDFKGRIYIIEGLSIQRIVRPSGKIDEYGVIMLKYFKEARKADEIKKDNYKPDGVFKLGENRPTRKMNHSQFTAFVEGIDFKVLPTGKFDKI

SEQ ID NO: 1272 - protein, 1458 aa, Artificial Sequence
  Cas9
MTKTILGLDLGTNSIGWALINQDFDNKKGEILGMGSRIIPMTQDIKDEFGKGNSISQTAERTRLRGVRRLIHRTLLRRERLHRVLNIIGFLPEHYANQIDFEKRFGKFKPESEPKISFDGNDVFLFEKSYQEMLVDFKIHQPQLVSNGKKIPHDWTIYYLRKKALSKKIEKEELAWILLNFNQKRGYYQLRGEEEEETPNKLVEFHSLKIVEVNADEPQKGKPEIWYSLVLENGWVYRRASKTPLFDWKDKIREFIVTTEINNDGTVKTDKEGTEKRSFRAPKPEDWTLQKKKTEFELSKSGNEVGAFIYESILQKPNQKIRGKLISTIERKFYKEELKTILKTQLFFHKELKDEKLYNACIEELYKNNEAHRSLLSNKGFEHLFINDILFYQRPLRSKKSQISNCPLEKRTYKKEGIEITEGIKVISKSNPIYQEFRLWQWISNLSLYCIEPTETNVTSTFLNSIEDYENLFEFLNNRKEIEQKHLLKYLLENQGFKGKLLTNELEKFRWNFVADKKYPCNETGSLLHTRLSKVKNISPDFLTKEIEHQLWHIIYSVTDKIEYEQALKTFARKNNLDVDSFFEHFKKIPPFESTYGAYSEKAIKKLLPLIRLGKYWNWEAIDSISKDRISKILSGEYDENIKNRVREKAVHLTSENNFQGLQEWLAKYIVYDRHSEGNDLGKWTSVSDLETYLKEFKQHSLRNPIVEQVITETLRVVKDIWIKHGKGTENFFDEIHVELGREMKNNSEDRKRLTNTITENENTNLRIKALLMEMMNDNDVENVRPYSPSQQEILKIYEDGALNSNIELDDEIVKISKKAEPTKSELQRYKLWLEQKYRSPYTGQVIPLNKLFTSEYEIEHVVPQSRFFDDSFSNKVICESAVNKRKDNQLGLQFIKNHSGEKVELGFGKVVQVFTEEQYLDFVKEHYSKNRSKHNKLLLEEIPEKMIERQLNDTRYISKFVSSILSNIVRSEKDDDGLNSKNILPGNGKITTELKRDWGLNDVWNDLILPRFERMNTITNSDLFTTYNDKYQKHLPTVPFEYSKGFQKKRIDHRHHAMDALVIACATRDHLNLMNNQSAKSELKRYDLQNKLRKKEPYFNQKENKQKEAFKDFIKPWGTFTEDSKNALEKIIISFKQNLRVINKATNSYESYKDEDGNLRIGKDGKPEKGLIKQKGLNWAIRKPLHKDTVSGQINLSRIKLPNGKILTATRKNLDTSFDLKTIENSITDTGIQKILKNYLLSKESPELAFSPEGLEEMNNEIEKYNNGKFHHPINKARIYELGSKFNVGQTGNRRDKFVEAAKGTNLFFAIYQDENKNRSYETIPLNEVIEHQKWRASLPKEEQEKIPLVPVNKLKGTFIFSLSPNDLVYVPSNDELERSASIDFSKLKKEQINRLYKMVSSSGSQCFFVKSEVATSVVNKMEYSSLNKMEKSIDNLMVKEICIKLKIDRLGNISKA

SEQ ID NO: 1273 - protein, 1458 aa, Artificial Sequence
  Cas9
MKKILGLDLGTNSIGWALIEQDFESKAGKISGAGSRIIPMSQDILGTFETGQSYSQTADRTHYRSIRRLYQRTKLRRERLHRSLNVLGFLPEHYKNEIDFEQRKGQFYPNKEPKIAYYPEQVASKVKYQFLFKSSFLEMVEDFKRRGYNGAIPYDWTIYYLRKKALEKKIEKEELAWLLLNFNQKRGYYQLRGEEEDTNSNKKEEFYELKVSSVEQTHDTSPSGTWYNVHLQNGWVYRRKSKDSLKDWEGLNKKFIVTTHLNADGSEKLDKDGNVSRSFRAPKEDDWGLVKKRTESVLEKSGLHVGEFIYESLLENPEQKIRGSLIKTIERKYYKKELEAILDKQTSFHRELRNDALYKEATLELYPKNSAHRSNIKQRGFKYLFIEDIIFYQRPLKSQKHLIAHCQYEKRTYKNNGGETIEVSLQGAPKSHPSFQEFRIWQFISNLRFYDKEEIVEGQEVSITEKLLKSDSDFAELYHWLSHQREVDQNKTLKYFTQKKLIPKQKKDNPTIRWNFPEDKKYEMGEFKAQLLSRLEKVRNCQPDKFLTQKNELDLWHIIYSVTDKTEFEKALVTFAEKRELDSESFVENFKKFPPFKNDYASYSLKAIKKILPLMRRGKYWKAENLGPQTLQRIEKIVNGEADDKISIRARKLALHLNDTKSFQGLPTSLACYVAYNRHSENEENQKWQTPSDIDKYLKDFKQHSLRNPIVEQLITEALRVVRDIWKHYGQGQKDFFDEIHVELGREMKNPAIKRKKLSQKIQENENTNYRIKEVLRNLKENNIDAKPYSPSHQEILKIYEEGVYQSIENVEDEIEKIRKNNTPSSKDINRYRLWLEQGYISPYTGEVIPLSQLFSNQYEIEHIIPRSRFFDDSLANKVICESSVNALKDNKTALEFITNHGNEKVEFAGKTVEILSSDKYTEHCKRYFKRNRTKLKNLLSYDVPEGFINRQLNDSRFISKYVRNLLSNIVREEEEREAISKHILTIPGSITSQLKQDWGLNEKWNEVVTHRFERLNNLTGTTDFGFWDNKINAFRITVPKELSKGFNKKRIDHRHHTLDALVIAACTKDHVNYITSLNTERNNHSLVSKLRNTKKVLINGKERRIAKAYKLPWSSFPLDAKHQLETTVISFKQNLRVINKSSNKTWQWRNVNGEQKKKLIPQTKGDSWAIRKSMHKATVSAKVESVGKGKIKTTNRTPLGEIKGEKHVEKIYDARIREVIIPNHLNKYLDEKGKPNYEAAFSQSGIKQLNENIEVLNEGKPHAPIYKVPLFEVGSKFPVSEDAKSPKNQKYVEADKGTNLFFAVYWNEEKQKRNFETVPLHQVIVHQKQVASLPTEQRTSVPIKPELGLFLFSLSPNDLVYVPTEEEIENPHLVDLKNLSKDQTNRIYKMVSSTGNECHFIPHHISRLIMKYNAKQKVGEFGSLNKAEKAITGETIKEKCLKIQINSLGKLKTERIA

SEQ ID NO: 1274 - protein, 1459 aa, Artificial Sequence
  Cas9
MKFNLGLDIGTNSIGWALVNEDYENKKGKIIAAGSRIIPMTQDILDKFGSGAITETQTALRTDYRSKRKLIQRFLLRRERLHRVLNVLDFLPKHYAESIDFEKYFGKFLPNTEPKLAYNQNQFIFQNSFLEMLKEFQEKHPELLTNNKKIPYDWTIYYLRKKALNQRIEKEELAWLLLQFNQKRGYNQLRDEEEESVPNKQVEFYSLKIIDVVADQPKEGRDKRWYSINLENGWTYRRESKTPLFNWEGKTKDFIVTTDLNQDGSIKKDKEGKEKRSFRAPSEGDWTLLKKKTEKEIYESGKTLGTYIYDALLNTPDLKIKGDFIRTIDRSIYKEELQQIINKQKEYHLELNSSKLYKACLEELYPKNEIYKSALKNKDIAYLFINDILYYQRPLKAPKYNIGKCTYESRTFKKEDKKIREYIPAVAKSHPLFQEFRLWQWIKNLKIYEKLSSDNCTDFFLTNEQDFENLFEFLWNKKEIDHKGILEYLVKTKFPDLKPKQVKTKVKEYRWNYVYDHEKDESKTYPCGETYFLLKNKLDKIYNAQDDFLDKERLYNLWHIIYSVTDKKQYEKALAKFALKNHLDTKSFVNTFKRIPPFKNDYAIYSLKAIKKLLPLMRVGKYWNYDDIDPITKQKIQCIITGEENDTISTLVREKTNHFSNENDFKNLPLWLAGYIVYNSHNESSEIEKWKSPQDIDTFLKKFKQHALRNPIVEQVVTETLRVVRDIWSKKGQGKKDFFNEIHIELGKDLKNPVDKRRKLSSTNTKNESTNTRIKALLIELFTQGVENVKPNSPKHQEILKIFEEGALNSGIEIEEDIIKISNTDQPTKKQLELYILWLEHKYKSPYTGQSIPLSKLFTPNYEIEHIIPRSKYYDDNLSNKVICETEINRLKNNQLGYEFINNHEIREVTLEEGKTIRLLSPEQYWNFVTTYYAKNKAKRENLLLKELPVQMVEKQLNDTRYVSKYVMQLLSKIVRKEDGTDNGINSTNILSISGKMTRALKNDWDLNDVWNDLLLYRFERLNTITKTNLFTTYSEQKQKRMPIVPDQYAKGFHKKRLDHRHHALDAIVIACITRNHINYMNNQNIQGEKLKKNAIEKENYREILQKSRLDIRAQLCEKKYNDNDPTKYNWVFIKPWADFTENTKDILESIIPSFKQNLRIINKTVNYYEKYNENGKKVKVRQIKGDNWAIRKPLHKETISGKVHLSYKTPAKGKILTATRKVLDSSMDFKSIEKITDTGIQKILKNYLEYKKSPELAFSPEGIEELNATITKYNNGFHHKPIYKVRIYEEGVKFPLGNKGNKKSKYVEAEKGTNLFFAIYKDQENNRYFETIPFNDVLETLKKGMSAVPEKNQEENTLVFALSPQDLVFVPTLDEIENPDIVDFKNLTKDQTNRIYKMVSSSGKQCFFIKAEVATSIVNKMEFSTSNKMENSIEGIQIKSNCWKLKLDRLGTITRVIK

SEQ ID NO: 1275 - protein, 1460 aa, Artificial Sequence
  Cas9
MTKFNLGLDIGTNSIGWALVNEDCENKKGKILAAGSRIIPMTQDILDKFGSGAATETQTALRTDYRSKRKLIQRFLLRRERLHRVLNVLDFLPKHYAESIDFEKYLGKFLPNTEPKLVYNQNQFIFQNSFFEMLKEFQEKHPELFLNNQKIPYDWTIYYLRKKALSQKIEKEELAWLLLQFNQKRGYNQLRDEEEENTPDKLVEFYSLKIIKVTADEAKEGINKRWYSINLENGWIYRRESKTPLFNWEGKTKNFIVTTDLNQDGSIKKDKEGKEKRSFRAPSEGDWTLLKKKTEKEIYESGKTLGTYIYDALLNNPDLKIKGALIKTIDRSIYKEELQQIINKQKEYHSELNNSKLYKACLEELYPKNEIYKNELKNKDIAYLFINDILYYQRPLKAPKYNIGKCSYESRTFKKEDKKITEFIPAVAKSHPLFQEFRLWQWIKNLKIYEKLTNDNYTDFFLTNERDIEKLFDFLWNKKEIDHKGILEYLIKTKFPDLKPKQVKSKVKEYRWNYIYDHEKDESKNYPCGETYFLLKNKLDKITSIQDDFLNKKRLENLWHIIYSVTDKKQYEKALAKFALKNQLDTKSFVNTFKRIPAFKNDYAIYSLKAIKKLLPLMRVGKYWNYDDIDPITKQKIQCIITGEENDTISTLVREKTNHFSNENDFKNLSLWLAGYIVYNSHNESSEIEKWKSPQDIDTFLKKFKQHALRNPIVEQVVTETLRVVRDIWLKKGQGKKDFFNEIHIELGKDLKNPVDKRRKISSTNSKNETTNIRIKALLKELLKEGIENIKPNSPKQQEILKIFEEGILNSGIDIEEEIIKISQIAQPTKKQLQYYRNWLEQKYISPYTGQFIPLSKLFTSKYEIEHIIPRSKYYDDSLSNKVICETEINRLKNNQLGYEFINNHEIREITLEEGKTIRLLSPKQYLDFVTTYYGKNKAKRENLLLKEIPIQMIENQLNDTRYVSKYVMQLLSKIVRKEDGTDNGTNSINILSVSGKITRVLKTDWGLNDVWNDLLCYRFERLNKITNTNLFTTYSEQKQKIIPIVPDQYAKGFHKKKLDHRHHALDAILIACITRNHINYMNNQNIQGEKLKNFKIDKHNYHEIFQKSRLDMRAQLCEKKYNDHDSTKYTWVFTKPWADFTENIKDTLEFIIPSFKQNLRIINKTVNYYEKYNENGKKVKVRQTKGDNWAIRKPLHKETISGKVHLLYKTPAKGKILTATRKVLDSSMDFKSIEKITDTGIQKILKNYLKYKESPELAFSPEGIEELNITIAKYNDGFYHKPIYKVRIYEEGVKFPLGNRGNKKNKYVEAEKGTNLFFAIYKDQENNRYFETIPFNDVLETLKKGMSAVPEKNQEKNTLVFALSPQDLVFVPTLDEIENPDIVDFRNLTKDQTNRIYKMVSSSGKQCFFIKAEVATSIVNKMEFTTSNKMENSIEGIQIKSNCWKLKLDRLGTITRVIK

SEQ ID NO: 1276 - protein, 1462 aa, Artificial Sequence
  Cas9
MTKNILGLDLGTNSIGWALIKQNFENKQGEILGMGSRIIPMSQDILGDFGKGNSVSQTAERTKYRSVRRLRERFLLRRERLHRVLNLLNFLPQHYASQIDFEKRFGKFKVETEPKLAWKNIDGQFSFLFQTSFNEMLEDFRVNGQDVKIPYDWTIYYLRKKALSKKIEKEELAWILLNFNQKRGYYQLRGEEEEENPNKLVEFYSLKVVDVVADEPQKGKFDIWYSLILENGWVYRRSSKIPLFDWKDKTRDFIVTTDLNDDGSIKKDKDGNEKRSFRAPSENDWTLVKKKTEQEIEQSRKTVGTYIYEALLDNPKQKIKGKLVRTIERKFYKEELRQILEKQKEFHQELQSDDLYNDCVRELYRNNEAHQLTLSKKDFVHLLMDDLIFYQRPLRSQKSSVSNCTLEFRKYKDENGAEHTQYLKAIPKSNPYYQEFRLWQWIYNLNIYRREDEQNPITGEFLSTTKEFENLFEFLNTRKEVDQKALLKHFKLNDKTHRWNFVEDKKYPCNETKTMISSRLEKVENISDDFLTREIEQKIWHIIYSVNDKIEYEKALKSFAKKHHLDESSFFEAFRKFPPFKSEYGSFSEKAVKKLLPLMRLGKYWNYADIDKSSKERIQKIISGEYDENIKDRVREKSVHLTTENDFQGLQLWLAQYIVYGRHSEASMIGKWNSADDLEEFLKNFKQHSLRNPIVEQVITETLRVVKDIWLKYGNGAKDFFNEIHIELGREMKLPAKEREDLTRKITENENTNLRIKALLAEMMNDSSVENVRPFSPMQQEILKIYEDGVLNSGIEIEDEYLKISKTAQPSPSDLKRYKLWLEQKYKSPYTGQIIPLNKLFTPEYEIEHIIPQSRYFDDSFSNKIICESAVNKLKDNYIGLGFIKQFGGTIIELGFGKSVKVFETEEYEDFVKKHYANNRSKRNKLLLEDIPEKMIERQINDTRHISKYISGVLSNIVRIDDDQAKKIIEDAEILARKEIDKDKANEIRRKAKSLATDDGINSKNIVPGNGKITTQLKQDWGLNDVWNDLILPRFERMNQLTNSKDFTVWNENHQKYLPTVPIEFSKGFSKKRIDHRHHALDALVIACATKDHVNLLNNQSAKSDTKRYDLKKKLMKFEKVVYHHTQTGNKIEREIPKQFLKPWENFTFDAKYNLESIIVSFKQNLRVINKATNYYEKYVEKDGTKNKGRVEQTGTNWAIRKPMHKDTVSGKVNLPWVKVPKGKILTATRKILDTSFDLKSIGSITDTGIQKILRNYLEFKGSPELAFSPEGIEDLNKNIEKYNDGKPHQPINKVRVFELGSKFQVGQTGNKKDKYVEAAKGTNLFFAVYEDKNGKRSYETIPLNEVIERQKQGLSVVDLKGTNDFYLCPNDLVYIPSDDELENINNIDFKNIAKEKNERIYKVVSFSGSQIFFVRQDIATSIVNKAELSTLNKMERAMDGSMIKESCVKLNVDRLGNISKA

SEQ ID NO: 1277 - protein, 1466 aa, Artificial Sequence
  Cas9
MTKNILGLDLGTNSIGWALIKQDFENKQGEILGMGSRIIPMSQDVLGEFGKGNSVSQTAARTDYRGVRRLRKRFLLRRERLHRVLNVLNFLPVHYASQIDFEKRFGKFKEDTEPKLAYNKEGFIFKNSFEEMVADFRKHQPQLLENDKKIPYDWTIYYLRKKALSKKIEKEELAWILLNFNQKRGYYQLRGEEEEENPNKLVEFYSLKITDVLADEPQKGKSDIWYSLILENGWIYRRSSKTPLFDWKEKTRDFIVTTDLNDDGSIKTDKDGNEKRSFRAPSENDWTLVKKKTEQEIDKSQKTVGTYIYETLLQNPKQKIKGKLVCTIERKFYKEELKQILEKQKEFHQELQNDDLYSDCVHELYRTNEAHQLTLSKKEIVNLFMEDLIFYQRPLRSQKTSISNCTLEFRKYKDENGVEHTQFLKAIPKSNPYYQEFRIWQWIFNLNIYKRDDDSNVTKEFLNTTEDFENLFEFLNNRKEVEQKALLKHFKLNEKLHRWNFVEDKKYPCNETKTMISTRLDKVENISKDFFTREIEQKIWHIIYSVNDKIEYEKALKSFAIKHNLDENSFFEAFKKFPPFKSEYGSFSEKAIKKLLPLMRLGKYWNEDEILKYSDDYFKNIESLLGVLKQRDENISDADRENYNKTINNKLRAELENFQNAEIESFQGLRLHIAQYILYGKHSEGDNKKFNSADDLEKFLKEFKQHSLRNPIVEQVITETLRVVKDIWTKYGNGAKDFFDEIHIELGRDMKKTRDERADATKIITENENTNLRIKALLAEMMNDVEMENVRPYSPMQQEILKIYEDGILKSDIEIEDDILKISKTAQPSSSDLKRYKLWLEQKYKSPYTGQIIPLNKLFTPEYEIEHIIPQSRYFDDSFSNKIICESAVNKLKDNYIGLGFIKQFGGTIVECGFGKNVKVFEAEEYEDFVKKHYANNRGKRNKLLLEEIPEKMIERQMNDTRHISKYISGVLSNIVRVEDGSDEGVNSKNIVPGNGKITTQLKQDWGLNDVWNELILPRFERMNQLTNSTDFTAWNENHQKFLPTVPIEFSKGFSKKRIDHRHHALDALIIACATKDHVNLLNNQSAKSDTKRYDLKKKLMKFEKVVYNHPQTGDRIEREVPKQFLKPWDNFTFEAKNNLDKIIVSFKQNLRVINKATNYYEKFVEKDGVKTKERVEQKGTNWAIRKSLHEETVSGKIDLPWVETNNGEFITATRKSLDASFNLEKIKKITDTGIQKILRNYLKAKDDNAELAFSPEGIEDLNKNIEKYNDGKSHQPIVRVRVYEKGKGRFALGQTGNNIDKYVQGSPNLFFAIYKDENGKKSYESIRLDIVIERMKQGLQAVPETNPNGISLYQNLSPLDLVYIPTEDEIESPHLIDFTILNKTRLERIYNVNDFSGYTIYFSQNSFAKNIYPKEMDMTWNEKKQKPSGSFDSKTASYNKKSIKDIFIKLKIDRLGNISKVSNTL

SEQ ID NO: 1278 - protein, 1466 aa, Artificial Sequence
  Cas9
MKNILGLDLGTNSIGWALVKEDFENKQGEILGLGSRIIPMSQDILGEFGRGNSISQTADRTGYRGVRRLRERHLLRRERLHRVLNILGFLPNHYAKEIDFTKRLGKFINHAEPKLSFDKEFIFKDSFNEMLKDFQQNQPGFIINKHGEEALVPYDWTIYYLRKKALTQKIDKEELAWILLNFNQKRGYYQLRGEEEEENTNKLVEFYSLKIIDVIADNEVNKKGEVWYSLHLENGWIYRRSSKISLVDWKDKVRDFIVTTDVNDDGSEKLDKDGVVKRSFRAPSADDWTLLKKKTEQDIDNSNKTVGAYIYENLLLNPKQKIKGKLVRTIERKFYKDELKQILEKQKEFHQELQNEQLLQDCVRELYKYNEQHQQMLESKDFVHLFLNDIIFYQRPLRSQKSLISNCTLEKRVSRDGVVFPIKVISKSNPYYQEFRLLQWLQNLAIYRKDDDVNVTQEFLNSIESWENLLQFLNAKKEIKQEQLIKFLLEQKGLKGNSLKTAILTYRWNYVTDKVYPMNETRSLIQDKLKKVENVATDFLSFDNEMALWHIIYSVNDKIEYEKALAKFASKHNLDEISFVESFKKFPPFKSDYGSFSEKAIKKLLPLMRFGSVWNKNNIVPSVLDRIDKILTGEYDEKIKIRVREKAEQFQLNQIEDFQNLPLWLAQYVVYDRHSEAEIAGKWNSVKDLENYLKEFKQHSLRNPIVEQIITETLRVVKDIWQQYGNGVQNFFDEIHIELGREMKNTADERKRITNSVTENENTNLRIKALLVELKEDTNIENVRPHSPMQQEILKIYEEGVLNAVENIDEDILKISKTAQPSKSELIRYKLWLEQKYQSPYTGEMIPLSRLFTSDYEIEHVIPQSRYFDDSLSNKVICEAAVNKRKDNQLGLEFIKNHHSEKIELGNGRTAQVLEVEAYESFVKKNYDKNRGKRNKLLLEDVPEKMIERQLNDTRYISKFVTHLLSNIVRKDEVNSKDDGINSKNIIPGNGKITSQLKQDWGLNDVWNELILPRFERMNNLTNSTDFTSTNTNGKIIPTVPLEYSKGFSKKRIDHRHHALDALVIALATRDHVNLLNNESALPKKDRTKEEQKSFRFDLQVNLRNKEKYFNVKEGREKEKFTTFKKPWNTLTQDTRDALENMVVSFKQNLRVINKATNYYESYTDENGNLRLDKYGNPKKELISQKGTNWAIRKSLHKETVSGQIHLDRVKVTKGKIVTATRKSLDSSFNEKSIESITDTGIQKILRNYLKAKDNKPDVAFSPEGIEELNKSISVYNEGKNHQPIIKVRIFEQGSKFPVGETGNKIAKFVEAAKGTNLFFGIYQDKTGKRSYDTIPLNLVIERLKQGLSPVPETNEKGHQLLFHLSPNDLVYVPTIDDNEQLDSNRVYKFTDSSDTTCNFIPSNISAIIFNINSKEQEKRGINYPIQNELGVGSPQSKNQKSFDGFMIKEVCIKLKVDRLGNISKT

SEQ ID NO: 1279 - protein, 1471 aa, Artificial Sequence
  Cas9
MCKYFYIKNFITFVLSKSIIPMKHILGLDLGSNSIGWAFVQQDFENKQGKIIATGSRIIPMDQGILGDFERGNTVSQTAERTTYRSTRRLRERHLLRRERLHRVLHILGFLPPHYDAQIDFTKRYGKFIDNAEPKIAYNNGNFIFMNSFNEMIEDFKKHQPQLFYKKSNGEESKIPYDWTIYYLRKKALSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDAPIKVCAKSNPYYQEFRVLQWLQNLRIYEIETDREVTAEFIETPQDCEALFNFLMSQKEIDNKGLLKYFLFAKNPQIKDKAAKSELKKWLTTYRWNYVYDAADNSSKKYPMNETGYELQRYLQKVEGLPANFLTFDITYQLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYGGGQANFFDEIHIELGRELKKTAEERKQLSDKNQENESTNLRIKKLLAELKEDASIQNVRPYSLVQQELLKIYEEGVFSATDEVEEDIQKIRKKAEPSKADLQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNKLILPRFERMNQLTQTQLFTSYNDRLQKNLPTVPIEYSQGFQKKRIDHRHHAMDALVIACATREHINYMNNQHALDKSKDKKEKQQSRIDLRTILCEKKNNNWQFKKPWSTFTQEAKEALEHIVVSFKQNLRVINKATNYYEKWEEKNGVLVKKKVKQEGTNWAIRKPLHKETVSGKIVLDRKIGKDKILTATRKAVDITFTEKIISSITDTGIQKILLNYLKYKGSPEVAFSTEGLEELNKNIAQYNNGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 1280 - protein, 1471 aa, Artificial Sequence
  Cas9
MGYKAPRNDKGEIDYGVGLDLGNGSVGWVAMDKDYHLIRARGHELIGARLFDPANSAENRRESRTTRRRLSRRRWRLRMLDSLFASELAKIDPNFLARRKYSWVHPKDEQNHENWYGSIIFGSKEQDKQFYKDYPTIYHLRKKLTEDTERHDIREIYVAIHHIVKYRGHFLREGEINSENLFDPEGFVELIKDVIKLNNSYDESTPIFEASPADVSEALLNEHTSRSGRIEDTLDKLDFSVSRVDKHELKGMRDAAKAVIGAIVGNTADFSKIFNLDNLDKDSKDNLKLKFADSNFDEKYGGVVGSGLLDETQIELVDRIHAVYDAVALKGILGDAHTISEAKVESYEKHRKNWKLIKEELRTKENKDEVDLWYGDLSGRQYKNPPDPEKGPDEGSKKDSPIRDSDQKQNLIKKANDYFTELIDDSQLSEEQKNCLKNDINNGQLFPVQRSSDNGVIPYQIHLNELRRIIENQKQYYPFLAETFIRKTAEGKSYEENKIVALLKFRVPYYVGPLVSKEDMEEHSSGNSAYHWMARNPGRGEAITPWNFDEVVDKDESGARFISRLTGTDTYLLGEPTLPQHSLLYEEYMVLSELNNVRLNVRQGNHWSDKNRQRLSYKQKEFLIENLFKEHKTVTRKRAEDCLSSMGCGEVQLFGLSDEKKFASSLSSYITLKKILGKAFVDDSGNSAILERIIEVQTVFEDREPLTHQLSLIDSLTVEQRKQLAKIHYTGWGKLSRKLLTSKKGSYKIHSQNEIMRTQHSIIDIMRGDSLNLIEIIRDKKIGIGEWIDNENLDRETGESDVSRLESVFEGIVMSPRVKRGVVQAVRVIDDLAKAIGNPPQRIFIEMADEVQASQRTVSRLSRLKALYGSPSLQKEFNDLKDLRKSLNETKDADLQEDRLYLYYIQLGKDLYTGKEISIDSLSSAYDIDHIVPQALTQDDSIDNRVLVSRKENARKTDSYLYTPDLIKNMRPLWGKLLAAGLMSQKKYDALTRVDDFKDREKQRFVQRSLVETRQIMKNVSTILRTYYGEDTNVVTLKSSITHDMRKYLGFPYKNRDINDYHHAQDALCISAAGQFMLNRHFVSGGEVTDGASNAYNMYLAEYLQEFRDAKARGERKRSTAFGFVVGSMSSKDDEKRTDHRTGEIVWSETNAEYLRKVMNYKKMLITQKVGDVKTRALYDETRYGHKESSAKSIKFDNLRRDTSLYGGFSGASTAYMMLVEYKKKNKLVSITAQEASLLAVADQKNDTVSVMDGILASHGLSGAKILLPKIVTGQLLDYSDALVTLQSASELNTARQMWLPRNDYNDIDIILKSKDIEDAAHKLGYDSDTVHVLRRIQKLFEAVFRVAESQFPLHQLSKDQQEEILRDPQNYGFGSAVKLLGGLLKALHANAENTNLAGLVKVLHGDKEYSDDGKAKEFKKFGFSPRWRRISNPTGFTLSDSDTFIYQSPSGIFEQRVTVKELKEKADKQK

SEQ ID NO: 1281 - protein, 1473 aa, Artificial Sequence
  Cas9
MKNILGLDLGTNSIGWALIEKDTDQKNGNILGTGSRIIPMSQDIKDEFGKGNSISQTADRTKFRSVRRLRERHLLRRERLHRVLNVLGFLPKHYADQIDFKKRLGKLVNETEPKLVYDNKNFIFKKSFEAMLSDFNQHQPLLLADGKKVPFDWTIYYLRKKALTEKIEKEELAWLILNFNQKRGYYQLRGEEEEENPNKMVAFHSLKIVEVIADESQKGKAETWYSLILENGWIYRRSSKTPLYDWKGKQRDFIVTTDLNDDGSIKTDKEGLEKRSFRAPVEDDWTLVKKKTEQEINRSHKTVGTYIYENLLQDPKQKIKGKLVRTIEREFYKDELKMILKNQQKFHPELNDEHLYINCVRELYRNNQAHQTILSKKDFVHLFIDDIIFYQRPLRSQKSSISNCTLEFRKYKNENGTDQTDYLKAIPKSHPLFQEFRLWQWIYNLGIYQKEDDTNVTDELIKNIDGYQDLFDFLNNKKEIRQDILIKFLVEQTGLKGKPLSSVVAKYRWNFVEDKIYPCNETGTQIRTRLAKVENTPEDFLTAETEIKLWHIIYSVNDKADYEKALKTFAEKHNLDTHSFVENFKKFPPFKSEYGSFSEKAIKKLLPLIRLGKYWSWENIDKKTQERIEKILTGEFDEAIKSRVRDKAIHLTEEDHFQGLQLWLASYVVYGRHSEADNLDKWHTVADLEDYLAEFRQHSLRNPIVEQVITETLRVVKDIWLQYGQGAKDFFSEIHIELAREMKNTGDERKRLTSLVTDNENTNLRIKVLLSELLNDGNVENVRPYSPMQQEALKIFEDGVLNSDIEIEDDILKISKMAQPTNTELKRYKLWLEQKYRSPYTGQIIPLNRLFTADYEIEHIIPQSRFFDDSFSNKIICESAVNQLKDKQLGLEFIKNHSGTIVKLGMGKTAKILDVESYNEFVKGNYTKNISKRNKLMLEEIPDKMIERQLNDTRYISKFIISALSNIVRSESNDDGFNSKNVLPGNGKITSRLKQDWGMNDIWNELILPRFERMNKITDSAVFTAWNENNQKFLPIVPLEFSKGFQKKRIDHRHHALDALVIAASTREHINLLNNEHAKSDKRFDLNRKLRKFEKVAYNDPKTGKRIEKEVPTIFLKPWETFTVDAKNSLESIIVSFKQNLRVINRATNYSESYNDENGALRLGKDGNPLKEKIKQSKGDSWAIRKPMHKDFVYGKVHLQNVKLPKDKFITAIRKSLDVTFDLKRIETITDTGIQKILKNYLHSKENKVELAFSPEGIEDMNQHIERYNDGKKHQPIHKVRVFEIGSRFSLGESGNKKTKFVEAAKGTNLFFAVYQDDNKGKRNYETIPLNIVIERQKLGLHSVPTEDAKGGKLLFHLSPNDMVYVPTSEELEDNLASVNIKRLNTAQRKRIYKVEKASGVECYFIRQDIAYLIKNYDAKTKIGELESQNKLQTTMTDDRLKITDVCVKLNIDRLGSIAETFLGNQYGASKKT

SEQ ID NO: 1282 - protein, 1473 aa, Artificial Sequence
  Cas9
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHNQFTAFVEGIDFKVLPSGKFEKI

SEQ ID NO: 1283 - protein, 1474 aa, Artificial Sequence
  Cas9
MKKILGLDLGTNSIGWALIESDFEKKQGKINGLGSRIIPMSQDILGKFDSGVSISQTAERTSYRGVRRLNQRNLLRRERLHRVLNILDFLPKHYSNAIDFEKKLGQFKENVEEKLNYAKNQIGRHEFIFMDSFKEMVKEFKQTQPQLFYKRENGIETKIPYDWTLYYLRKKALSQKIKKEELAWIILNFNQKRGYYQLRGEDVLDESKIEDFYSLKVVEVQETEDKNARGTWYNVILENDWVYKRQSKESLDNWIGKNKEFIVTTNKEKDGSLKLDKAGNVKRNFRAVDSEKDWIAIKKKTEQDVEISKHTVGQYIYETLLQNAKQKIKGKLVKTIERKFYKEEFIKIIKEQLKHHPELQSKTLYETCIQELYPRNEAHQNNIKSKGFEYLFTDDIIFYQRPLKSKKSTISGCQYETRLFKKTVLNKVTNKENEIWQKEPLKAISKSHPLFQEFRLWQFLKNLKIYQKEDVKGNLIDHDITSDLLKTEADWVELFDFLNIKKEIEQKQIIQFFINNKQIEKGKKNNYRWNYVEDKKYPCNETKSQLISRLKKVKNLDLNLFFTSETELKLWHIIYSVKDKIQYEKAIKNFAIKNNIDIDSFVENFKRFPPFKNEYAAYSEKAIKRLLPLMRMGEYWNESEIKQEVKDRAYSIIERLKGIDFNKDKIDEKITDDDIKKQLLKSFIDFKDKNPLKGLNTYQACYLVYNRHSEVNSIAYWKSPDDINKYLEGFKQHSLRNPIVEQVVTETLRTVRDIWQYYGKGKASFFNEIHVELGREMKNPAYKRKASTNRVTENENTNHRIKEILKELQNEGVQEVKSYSRNQQEILKIYEEGIYQSIDVVDDAIEKIRKNSSPTKAEIIKYKLWLEQGYTSPYTGKTIPMSKLFTTDYQIEHIIPQSLYFDNSLSNKIICESEVNQLKDNQTAYEFIKKHGTEKVSLGKNKTVEIFTLEQYEKHCNQYFKKNKNKLKKLLSEEIPEGFINRQLNDSRYISKFIKGLLGNLVREEDEQEVTTKHIVPVTGAITSKLKQDWGLNDKWNELVASRFQRLNTMTNSNNFGYWDTKINAFRVQVPDEISKGFSKKRIDHRHHALDALVIACCTRNHINYLNALNAEKKNYGLRDLLLIKNDKNHYTKFFKHPWDGFPVEAKSVLEKTIISFKQNTRVINKTNNKTWQWAEKEGQLKKVLVKQTKGDNWAIRKPMHKETVSGKLNIPTPKGKIATASRVSLSEIKTRKQLDKITDISIQKILERHLNNYLDDKGKEKFDLAFNADGVEELNKNIKVLNKGKNHQPIYKVRLYEIGSRFKVGNSGNKKDKYVEAAKGTNLFFAIYLNEKDKKRVYETIPLNEVIEHQKQVSNLPKNERTPVPVNHTKGKFLFSLSPNDLVYVPTDEEIDNPSLVNFNNLNKKQVEKIYKTVSCSTYQCFFVHNTISKPIQNKVEFSALNKMEKSIDGIMIKDRCWKLKMDRLGNIISVIR

SEQ ID NO: 1284 - protein, 1480 aa, Artificial Sequence
  Cas9
MKTILGLDLGTNSIGWAKVCVDNDGNYLRDIKLGSRIIPMSQDTLGNFDKGVTDSPTAARTGFRGVRRIRERALQRRERLHRVLHVMKFLPPHYENAIGWNREEATTYGKFLNHGEPKLAWEKQEDGSMRFLFMDSFHEMMADFAESQPGLVAGGKKIPLDWTLYYLRKKALTQAIRKEELAWILLNFNQKRGYYQLRGEEDEENPAKREEYHELKVVSVEAAEEGKGGNTWYNVTLENGWIYRRQSKVELHDWVGKTRQFIVTTEYEKDGVTIKKDKNGEVKRSFRAPSEDDWGLRKKRTESLLEDSGKTVGAFIYDHILSEPTDKIRGNFIRTIERKYYKKELEAILLEQTKHHKELKDQNTLIACIKELYQSNKPHQDSLMKKDMTYLLITDLIFYQRPLKSKKSLIADCPYEYYEYTIKETGEIKRQGIKCIAKSNPYYQEFRLWQFIINLRLFDRTDDKEVTSEYLSSMEDYTKLFTYLNDRKDINQETLLKDFFKQKKVKMGMEKEFPIRWNYIEDKEKKYPCNETRHELLAALDKAGIDHSWLDDKERFYRLWHLLYSVESKEEAEGALRKLKDNDDFVNAFLKVKPFKKDYGAYSEKAVKKLLAIMRMGGLWNETDICEQTRNRIQSIIKGEIDEKIKERMGRTFCQLSDFQGLPEWLACYVVYGRHSEATDIQRWTKPENLMAYINGFKQHSLRNPIVEQCILETLRTVHDIWKEAGHIDEIHVELGRSMKSTADQRARMSKSILQNENTNLRIKSLLMELKNAKEIENVRPYSPMQQEILRIYEEGALQELTKEDAQYPEISKISQMAQPSAKELLKYRLWLEQKYCSPYTGKPISLSKLFTSAYQIEHIIPQSRYFDDSFTNKVICETEVNQLKSNMLGYEFIKKHSGEIVHCTTIGDVKILDAKEYYNFVTEHYANNRRKKEKLLLEDIPQEFLNRQMNDSRYISKKVMAILSNIVREEDEQETNSKFVVSCSGGITDRLKQDWGLNDVWNSIVYPRFERLNKLTQTEAFGRWENKEGKQVFQTSLPLELQRGFSKKRIDHRHHAMDALVIACASRNIINYLNNESAKSQEQREDLRKKLCDKNRIIRKPWETFTQDARTALEDVVVSFKNYVRVINKATNYYEKYDESGKKGMAEQKGQDMWAIRKPMHKETVFGQVNLRRKVTVKLKDALENIPAICDKALRDYVNDLIAKKFNTKQMLAHFKSINYRLNMKSVNKVGIWVFSDEKEPMVATRKAIDISFDAKRIDTITDTGIQQILCKYLKSKGNDPNVAFTPEGIAEMNKHIIDYNNGKQHQPILKVRVSEPKGAKYQVGETGNKTKKFVEAQKGTNLYFAIYEDKDGNRSYNTIPLNEVAERLKQGLSPVPEKNEKGISLKFYLSPNDLVYVPTEEEKLSNECKLSKERIYKMVSSTSNECHFIPYTTAKPIYDKFEYEAKNKMGRALTGEMIKAVCWKLEVDRLGNILKIIK

SEQ ID NO: 1285 - protein, 1483 aa, Artificial Sequence
  Cas9
MKTILGLDLGTNSIGWAKISIDDNGNYLRDIQMGSRIIPMSQDVLGNFDSGVTESQTAVRTGFRGLRRIRERSLLRRERLHRVLHVMGFLPPHYDSAIGWNKEEPTTYGKFLNHGEPKLAWERQGDGSMRFLFMDSFHKMMEDFAPHQPALVADGRKIPLDWTLYYLRKKALTQPIKKEELAWILLNFNQKRGYYQLRGEEEEENPTKREEYHELKVVSVEAAEEGKGGNTWYNVKLENGWIYRRSSKIPLDDWVGKTRPFIVTTEYEADGITLKKNKEGEVKRSFRAPGEDDWGLRKKRTESQLEASGKTVGAFIYDHLLAEPADKIRGNFIRTIERKYYKQELADILREQSKYHEELQSKKILADCAEELYRSNQPHRDSLLKKDMVYLLLTDIIFYQRPLKSKKSLIADCPYEYYEYVDKETGEIKRQGIKCVAKSNPYYQEFRLWQFVLNLRLYDRTEDKEVTAEYLPSKEDYARLFVYLNDRKEINQETLLKDFFKLKKVKQRSEKEFPVRWNYIEDKEKKYPCNETRHELLMALDRAGIERSWLDDTARQCRLWHLLYSIEVKDEAERALRKLKDDDEFVSAFLKVKPFKKDYGAYSEKAVKKLLAVMRMGSHWCEDDICKETKERIEHILQGDVEEKIKERMNHTAYSLGELSDFQALPEWLACYVVYGRHSEATDIKHWKTPESLMAYINGFKQHSLRNPIVEQCILETLRTVHDIWKEAGHIDEIHVELGRSMKSTSDQRARMTENILRNENTNLRIKSLLMELKNDADIKDVRPYSPMQQEILRIYEEGALQELTKEDNDYEEIFKISKMPQPSAKELLKYKLWLEQKYRSPYTGKPISLSKLFTSAYQIEHIIPQSRYFDDSFNNKVICESEVNALKGNMLGYEFIKNHGGEIVHCTLLGDVKVQNESEYKAFVTEHYANNKYKKEKLLMEDIPQDFLNRHLNDSRYISKVVKTLLSNIVRTEDEMETTSKFVVSCTGGITDRLKKDWGLNDVWNSIVYSRFERLNELTKSDAFGRWENKEGKRVFQTSVPLELQRGFNKKRIDHRHHAMDALVIACASRNIINYLNNESANSPKKREDLRQQLCDKNRIIRKPWESFTQDARAALEDVVVSFKNYVRVINKATNYYERYDADGKKTITKQKSREMWAVRKPMHKETVFGHVNLRRKAIVKLKDALENIPSICNKELRDYINGLVERNFNTKQLHAHFRSTDYRWNKQNVDKVEVWRFSDEKEPLVATRKPLDTSFDAKRIDTITDTGIQKILLNYLEAKGGDPLIAFTPEGIAEMNQNIALYNDGKMHQPILKVRISEPKGAKYQIGQTGNKADKFVEAQKGTNLYFAIYEDEDRNRTYNTIPLNEVAERLKQGLPPVPEKNEKEVPLKFYLSPNDLVYVPTEEEILMKECKLNKNRIYKMVSSTGNQCFFIPFRVAVSIVNKMEYSPLNKMEKAISSEMIKAVCWKLEVDRLGNIIRVVK

SEQ ID NO: 1286 - protein, 1483 aa, Artificial Sequence
  Cas9
MKTILGLDLGTNSIGWAKVSLDDNGNYLHDIKLGCRIIPMSQDVLDNFGKGVTVSQTSVRTGFRGVRRIRERSLQRRERLHRVLHRLGFLPQHYDAAIGWDSDCAKTYGKFLDNGEPKLAWERQEDGSMRFLFMNSFYEMIADFTSHQPALVADGKKIPLDWTLYYLRKKALTQAIRKEELAWILLSFNQKRGYYQLRGEEEDENPTKREEFCELKVVAVEAAEKGKGDDIWYNVHLENGCIYRRSSKISLDDWVGKTKQFIITTEYEKDGVTPKKDKDGKEKRSYRAPKEDDWGLRKKRTETDLEASGKTVGAFIYEHLLAEPFDKIRGNFIHTIERKYYRAELEAILTEQRKYHEELRSEQMLAVCAEELYRSNLPHQQSLLKKDMVYLLLSDLIFYQRPLKSKKSLIADCPYEYYRYVDKETGEIKKQGIKCIAKSNPYYQEFRLWQFVLNLRLFDRMTDKEVTADYLPTKEDYVRLFDYLNNRKEINQETLLKDFFRLKKVKLGREKEFEIRWNYIEDKEKKYPCNETRYELLVALDRAGIDRSWIDEDGRQYRLWHLLYSIEVKAEAESALRKLNSDDAFVSSFLKVKPFKKDYGAYSEKAVKKLLAVMRMGSMWSEANICEETQNRIRSIIRGDIEEKIKERMGHTARSFNQIDDFQALPEWLACYVVYGRHSEVTDIQHWETPEQLQSYINGFKQHSLRNPIVEQCILETLRTVHDIWKEAGHIDEIHVELGRDMKRTADQRARMTKNILKNENTNLRIKSLLMELKKDTDIKEVRPYSPMQQEILRIYEEGALLQLKRDDEAFADISKISQMAQPTATELRRYKLWLDQKYRSPYTGKFISLSKLFTSAYQIEHVIPQSRYFDDSFSNKVICEAEVNRLKSNMLGYEFIKAHGGEIVHCTMLGDVKILSESEYKAFVNEHYVNHRAKKEKLLMEDIPQEFLNRQMNDSRYISKVVKALLSNIVRTEDEMDVTSKFVVPCSGGITDRLKKDWGLNDVWNSIVYPRFERLNRMTGTEAFGHWENKEGKRVFQTSVPIELQLGFSKKRIDHRHHAMDALVIACASRNIINYLNNESANSQKKREDLRRLLCDKNRIIRKPWESFTQDARVALQDIVVSFKNYVRIINKATNYYERYDEQGKKTTAEQKSSEMWAIRKPMHKETVFGHVNLKRKTTVKLKNAIENIPNICNKELKAYINELVEKHFNTKQMLAHFKSINYRWNRQNVEKVEVWQYSDEKERMAATRKPLDTSFDKKRIETITDTGIQKILLNYLEEKGGDPNIAFTPEGIAEMNKNISLFNDGKLHQPILKVRVAKTMGAKYQVGQTGNKAAKYVGAQEGTNLYFAIYENEEGERSYNAVPLNEVAERLKQGMSPVPEKNEKDVPLKFYLSPNDLVYVPTEEDKLSNECKLDNERIYKMVSATGKKCHFLPYSVANIIYNKVEFESMNKMGKALSGEMIKAVCWKLEVDRLGTILRVIK

SEQ ID NO: 1287 - protein, 1483 aa, Artificial Sequence
  Cas9
MKTELDLNKDRLYKHVLGLDLGVTSIGFAHVVESENRNESEIKQIGVRVIQLDNFDKVDKSGKTSESKNPAVDFAAGKGLTPNGSRTKKRGARRNLDRYQDRRDNLLEVLTKSGFINSETKRTEDGKHTTHQTWEIRAKAVSEKVEKEEFARILLAINKKRGYKSSRKAKNEDEGQAVDGMAVAKRLYEENLTPGQYAYEVLSGGKKSIPDFYRSDLQAEFDKIWNFQKQFYPNILTDEFYEELKGKGQRATSAAFWKIHQFNTADIKDLEDELKNERTIKLSKRDQKKLQAYKWRSEAVVKQLGKEEVAYVLTEINNNLNNSSGYLGAISDRSKELYFNKQTVGQFLYKQLKENPHTRLKNQVFYRQDYLDEFETIWEMQAQFHPELTQELKEEIRDIIIFYQRKLKSQKGLISFCELESKEVVINDTKKIIGLRVAPKSSPLFQEFKIWQNLNNVLVRKKGSRKRMVKAQNQHSLFEEPKEIFSLDLASKEKLFEELNLKGNLSAKNCLDILGLNSNEWELNYTQLEGNRTNKSLYEAFLKILDIEGYDVKDLLKVKSSKDEVELDDLKVPASEIKNMVREIFSTNKIDTEILDFDAEIDGKAFEKQSSYQLWHLLYSYEGDDSQSGNEKLYELLAKKFGFKREHAQILANVSLVDDYGNLSSKAMRKIYPHIRENNYSTACELVGYRHSKHSLTKDELKDRVLEDRLELLKKNSLRQPVVEKILNQMINAVNALIEKNSERDENGNITKYFKFDEIRIELARELKKNAAERAEMTTNINAAKLVHEKIFKILQNEFGIKNPTRNDIIRYRLYEELKGNGYKDLYSNTYIPREILFSNQIDIDHILPQSRLFDDSFSNKVVVFRKDNLKKGNQTAIDYIGSEVGEEGLKNFIERVESLYELGKKNKEEGISKAKYQKLLKSASEIGDGFIERDLRESQYIAKKAKELLFKVTRSVVSTSGSITDRLREDWGLINVMKELNLPKYKSLGLTEIQERRNGHQVEVIKDWTKRNDHRHHAMDALAVAFTKHNHIQYLNYLNARKNESHKLHGNIIAIETLETEVKIDDLGNKKRVFKEPIPNFRQVAKEHLENVLISHKAKNKVVTKNKNKISGKEKLQITLTPRGQLHKETVYGKYRFYQSKDEKVSAKFDLETIEKVANPSYKAALLQRLNENENDPKKAFSGKNALSKNPIYISMENDIKVPDTVKLVWLEEDYSIRKDVTPENFKDEKSIEKILDEGVKRILKNRLKEFGGDAKEAFSDLDKNPIWLNEEKGTSIKRVRISGVKNAEPLHYKKDHFGNDILDGNGNKIPADFVSTGNNHHVAIYKEPEFDKKGQPVLDELGNQKYNLQEKVVSFFEAVERVNQGLPIIDKTYNQHLGWQFFFTMKQNEMFVFPNEKTRFNPIEIDLLDPNNKKLISLNLFRVQKIANKNYMFRHHLETNVDDKKEMKNIAFIHIQSCNLLKEIIKVRLNHLGDIVSVGEY

SEQ ID NO: 1288 - protein, 1483 aa, Artificial Sequence
  Cas9
MKTILGLDLGTNSIGWAKVSVDDHGNYLHDIKLGSRIIPMSQDILGNFDKGVTESQTAIRTGFRSVRRIRERSLLRRERLHRVLHVMGFLPPHYDSAIGWNREEASTYGKFLNHGEPKLAWERLEDGSMRFLFMDSFHEMMANFARHQPALVADGRKIPLDWTLYYLRKKALSQAVGKEELAWILLNFNQKRGYCQLRGEEEEETPTKREEYYELKVVSVEAAEEGKGGNTWYRVQLENGWIYRRPSKIALDDWVGKTKQFIVTTEYEKDGTTLKKDKDGEVKRSFRAPGENDWGLRKKRTESQLEASGKTVGAFIYDHLLAEPADKIRGNFIRTIERKYYKQELEAILREQTKHHEELRSKEMLAKCAEELYQSNQPHRKSLLNKDMTYLLLTDLIFYQRPLKSKKSLIAECPYEYYKYKDKEKGKKKRQGIKCVAKSNPYYQEFRLWQFIVNLRLFDRTDDKEVTAEYLRSREDYARLFAYLNDRKEINQETLLKDFFGLKKVKIGAEKEFAIRWNYIEDKEKKYPCNETRHELLLALDRAGMDRSWLDDSELQYRLWHLLYSVEARDEAEGALRKLRDDDEFVGAFLKVKPFKKDYGAYSEKAVKKLLAVMRMGSWWHEEDICKQTRDRIERIVQGDIEEKIRERMGHAAYSFSRLADFQGLPEWLACYVVYGRHSEATHILRWDSPDKLLSYIKGFRQHSLRNPIVEQCILETLRTVHDIWKEAGHIDEIHVELGRSMKSTAEQRAHMTKNILRNENTNLRIKCLLMELKNDADVKDVRPYSPMQQEILRIYEEGALQQLTKDDAEYAEISKISKMAQPSAKELLRYKLWLEQKYRSPYTGKPISLSKLFTSAYQIEHVIPQSRYFDDSFNNKVICESEVNTLKSNMLGYEFIKNHCGEIVHCTMLGDVKVFSESEYKAFVTEHYSNNKYKKEKLLLEDIPQEFLNRQMNDSRYISKVVKGLLSNVVRTEDELEATSKFVVSCTGGITDRLKKDWGLNDVWNSIVYSRFERLNGLTKSEHFGHWENKEGKRVFQTSVPMELQRGFNKKRIDHRHHAMDALVIACASRNIINYLNNEFAKSPKQREDLRQLLCDKNRIIRKPWETFTQDARAALEDVVVSFKNYVRVINKTTNYYERYDADGKKTMVPQKGNEMWAVRKPMHEGTMYGRVNLRRKAVVKLKEALENISSICNKELRDYINVLVEKQFNTKQLLAHFKSMDYRWNKQHIDKVEVWRFSDEKVQMVAARKPLDTSFDKECIASITDTGIQKILLNYLESKGGDPAIAFTSEGIAEMNQNIAVYNDGKKHQPVIKVRKSTKLGKKFAVGQIGCKSKQFVVAEAGTNLYFAIYEDEEGKRSYDTIPLNEVTERLKQGLSPVPEKNEKEVPLKFYLSPNDLVYVPTEDEMQMKECKLNKERIYKMVSSTGNECHFLPYSVASVIYNKVEFESMNKMGRALTGEMIKAVCWKLDVDRLGNILRVIK

SEQ ID NO: 1289 - protein, 1483 aa, Artificial Sequence
  Cas9
MKTILGLDLGTNSIGWAKISIDDNGNYLRDIQLGSRIIPMSQDVLGNFDNGVTESQTAVRTGFRGLRRIRERSLLRRERLHRVLHVMGFLPPHYDSAIGWNKEEPTTYGKFLNHGEPKLAWERQGDGSMRFLFMDSFHKMMEDFAPHQPALVADGRKIPLDWTLYYLRKKALTQPIKKEELAWILLNFNQKRGYYQLRGEEEEENPTKREEYHELKVVGVEAAEEGKGGNTWYNVKLENGWIYRRSSKIPLDDWVGKTRPFIVTTEYEADGITLKKNKEGEVKRSFRAPGEDDWGLWKKRTESQLEASGKTVGAFIYDHLLAEPADKIRGNFIRTIERKYYKQELADILREQSKYHEELQSKKILADCAEELYRSNQPHRDSLLKKDMVYLLLTDLIFYQRPLKSKKSLIADCPYEYYEYVDKETGEIKRQGIKCIAKSNPYYQEFRLWQFVLNLRLYDRTEDKEVTAEYLPSKEDYARLFVYLNDRKEINQETLLKDFFKLKKVKQRSEKDFPVRWNYIEDKEKKYPCNETRHELLMALDRAGIERSWLDDTARQYRLWHLLYSIEVKDEAERALRKLKDDDEFVSAFLKVKPFKKDYGAYSEKAVKKLLAVMRMGSHWCEDDICKETKERIEHILQGDVGEKIKERMNHTAYSLGELSDFQALPEWLACYVVYGRHSEATDIKHWKTPESLMAYINGFKQHSLRNPIVEQCILETLRTVHDIWKEAGHIDEIHVELGRSMKSTSDQRARMTENILRNENTNLRIKSLLMELKNDADIKDVRPYSPMQQEILRIYEEGALQELTKEDNDYEEIFKISKMPQPSAKELLKYKLWLEQKYRSPYTGKPISLSKLFTSAYQIEHIIPQSRYFDDSFNNKVICESEVNALKGNMLGYEFIKNHGGEIVHCTLLGDVKVQNESEYKAFVTEHYANNKYKKEKLLMEDIPQDFLNRHLNDSRYISKVVKTLLSNIVRTEDEMETTSKFVVSCTGGITDRLKKDWGLNDVWNSIVYSRFERLNELTKSDAFGRWENKEGKRVFQTSVPLELQRGFNKKRIDHRHHAMDALVIACASRNIINYLNNESANSPKKREDLRQQLCDKNRIIRKPWESFTQDARAALEDVVVSFKNYVRVINKATNYYERYDADGKKTITKQKSREMWAVRKPMHKETVFGHVNLRRKAIVKLKDALENIPSICNKELRDYINGLVERNFNTKQLHAHFRSTDYRWNKQNVDKVEVWRFSDEKEPLVATRKPLDTSFDAKRIDTITDTGIQKILLNYLEAKGGDPLIAFTPEGIAEMNQNIALYNDGKMHQPILKVRISEPKGAKYQIGQTGNKADKFVEAQKGTNLYFAIYEDEDRNRTYNTIPLNEVAERLKQGLPPVPEKNEKEVPLKFYLSPNDLVYVPTEEEILMKECKLNKNRIYKMVSSTGNQCFFIPFRVAVSIVNKMEYSPLNKMEKAISSEMIKAVCWKLEVDRLGNIIRVVK

SEQ ID NO: 1290 - protein, 1485 aa, Artificial Sequence
  Cas9
MKNILGLDLGTNSIGWAKISIDDNGKYIKDSIKLGSRIIPMSQDVLSNFSKGVTLSQTSERTSFRGARRLRERTLLRRERLHRILHLLGFLPKHYEKAIGWDRNDNKTYGKFINHAEPKLAWCKDNNGKMRFLFMDSFHDMLSEFSEKHPELLANGKKIPLDWTIYYLRKKALYKAITKEELAWILLNFNQKRGYYQLRGEEDRDSEANKKEYLELKVIGVEATGEKKGNDIWYNIHLENGWIYRRSSKNPLNDWLGKVKSFIVTTDLDADGNPKKDKDGNIKRSFRAPSEGDWTLIKKRTESLLENSGQTVGQFIYNHILEEPSAKIRGNFIRTIERKYYKDELKAILEKQKEFHHELSSESLLTECAKELYKRNIAHQEVLLKKGMIHLLLNDILFYQRPLKIKKSLIDNCPYENYKYVDKKSGDIKVKSIKCIAKSNPFFQEFRLWQFVSNLRLYRKSDDKDVTSEHLVTTDDYANLFTYLNNRKDIKQSVLLKEYFKIKKVKTINGAEYPVRWNYIDDDNKTYPCNETRYDILHALSKTELKSEWLTPERTYRLWHLLYSIESKEETKKALNKLNLSDDFTEAFLTIKPFKKEYGSYSEKAIKKLLSLMRMGYLWSEDEAIKQVGAEIEKTIEGELPDYVLQRLEKSQHNYNKISDFSGLPLWLASYIIYGRHSEAKEIIHWDNPESMMAYIKDFRQHSMRNPIVEQCVLETLRTVHDIWKEIGHIDEIHIELGREMKSTSEQRKAITQNVLHNQNTNIRIKLLLQELKNDNNITGVRPYSPMQQEILRIYEEGALQGLTKEDKDYNDILKISQTAQPTSNELTRYKLWLEQKYRSPYTGKAISLSKLFTSAYQIEHVIPQSRYFDDSLSNKVICESEVNTLKKAMLGMEFIKTCGGQKVHCTLLGDVEIYNEEDYKAFVNEHYSNNRTKRNKLLMEDIPQEFINRQLNDSRYISKMVKQLLSAIVRGQEEVEATSKFVIPCTGGITDRLKKDWGLNDIWNNLVSPRFQRMNALTGSEYFGHWENKEGKRVFQTTMPIQLQQGFSKKRIDHRHHAMDALVIACASRNIISYLNNETAQDTERRRDLRQKLCDKGGSVRKPWDSFTQDTQYALKDIIVTFKNYVRIINKATNYYEHYKTDGKKGMISQKGDELWAIRKPMHKETVFGKVNLRRPKRVSLSKAIDSVDVICNRKLKKYIKARLNEGLQKKQILNIFKEVNNVWEGIDVNKIDIWEMSNDKEPMVATRKQLDTSFDEKKIRSISDTGIQKILLNYLITKNNNPELAFTPEGIQEMNSNISEYNDHKKHQPIYKVRVTEPLGAKYPIGTMGNNPKKFVEAQAGTNLYFAIYEDKEGNRNYDTIPLNIAAERLNQQLSPVPETNENNTPLKFYLSPNDLVYVPSEEERHSGNNIQLDKNRIYKMVSSTSKQCFFIHHRVAISLVDKKEFSAQNKMERSIDNEQVMIKSVCWKLITDRLGNIIKVIK

SEQ ID NO: 1291 - protein, 1485 aa, Artificial Sequence
  Cas9
MKNILGLDLGTNSIGWAKISIDDNGKYIKDSIKLGSRIIPMSQDVLSNFSKGVTLSQTSERTSFRGARRLRERTLLRRERLHRILHLLGFLPKHYEKAIGWDRNDNKTYGKFINHAEPKLAWCKDNNGKMRFLFMDSFHDMLSEFSEKHPELLANGKKIPLDWTIYYLRKKALYKAITKEELAWILLNFNQKRGYYQLRGEEDRDSEANKKEYLELKVIGVEATGEKKGNDIWYNIHLENGWIYRRSSKNPLNDWLGKVKSFIVTTDLDADGNPKKDKDGNIKRSFRAPSEGDWTLIKKRTESLLENSGQTVGQFIYNHILEEPSAKIRGNFIRTIERKYYKDELKAILEKQKEFHHELSSESLLTECAKELYKRNIAHQEVLLKKGIIHLLLNDILFYQRPLKIKKSLIDNCPYENYKYVDKKSGDIKVKSIKCIAKSNPFFQEFRLWQFVSNLRLYRKSDDKDVTSEHLVTTDDYANLFTYLNNRKDIKQSVLLKEYFKIKKVKTINGAEYPVRWNYIDDDNKTYPCNETRYDILHALSKTELKSEWLTPERTYRLWHLLYSIESKEETKKALNKLNLSDDFTEAFLTIKPFKKEYGSYSEKAIKKLLSLMRMGYLWSEDEAIKQVGAEIEKTIEGELPDYVLQRLEKSQHNYNKISDFSGLPLWLASYIIYGRHSEAKEIIHWDNPESMMAYIKDFRQHSMRNPIVEQCVLETLRTVHDIWKEIGHIDEIHIELGREMKSTSEQRKAITQNVLHNQNTNIRIKLLLQELKNDNNITGVRPYSPMQQEILRIYEEGALQGLTKEDKDYNDILKISQTAQPTSNELTRYKLWLEQKYRSPYTGKAISLSKLFTSAYQIEHVIPQSRYFDDSLSNKVICESEVNTLKKAMLGMEFIKTCGGQKVHCTLLGDVEIYNEEDYKAFVNEHYSNNRTKRNKLLMEDIPQEFINRQLNDSRYISKMVKQLLSAIVRGQEEVEATSKFVIPCTGGITDRLKKDWGLNDIWNNLVSPRFQRMNALTGSEYFGHWENKEGKRVFQTTMPIQLQQGFSKKRIDHRHHAMDALVIACASRNIISYLNNETAQDTERRRDLRQKLCDKGGSVRKPWDSFTQDTQYALKDIIVTFKNYVRIINKATNYYEHYKTDGKKGMISQKGDELWAIRKPMHKETVFGKVNLRRPKRVSLSKAIDSVDIICNRKLKKYIKARLNEGLQKKQILNIFKELNNVWEGIDVNKIDIWEMSNDKEPMVATRKQLDTSFDEKKIRSISDTGIQKILLNYLITKNNNPELAFTPEGIQEMNSNISEYNDHKKHQPIYKVRVTEPLGAKYPIGTMGNNPKKFVEAQAGTNLYFAIYEDKEGKRNYDTIPLNIAAERLNQQLSPVPETNENNTPLKFYLSPNDLVYVPSEEERHSGNNIQLDKNRIYKMVSSTSKRCFFIHHRVAISLVDKKEFSAQNKMERSIDNEQVMIKSVCWKLITDRLGNIIKVIK

SEQ ID NO: 1292 - protein, 1485 aa, Artificial Sequence
  Cas9
MKNILGLDLGTNSIGWAKISIDDNGKYIKDSIKLGSRIIPMSQDVLSNFSKGVTLSQTSERTSFRGARRLRERTLLRRERLHRILHLLGFLPKHYEKAIGWDRNDNKTYGKFINHAEPKLAWCKDNNGKMRFLFMDSFHDMLSEFSEKHPELLANGKKIPLDWTIYYLRKKALYKAITKEELAWILLNFNQKRGYYQLRGEEDRDSEANKKEYLELKVIGVEATGEKKGNDIWYNIHLENGWIYRRSSKNPLNDWLGKVKSFIVTTDLDADGNPKKDKDGNIKRSFRAPSEGDWTLIKKRTESLLENSGQTVGQFIYNHILEEPSAKIRGNFIRTIERKYYKDELKAILEKQKEFHHELSSESLLTECAKELYKRNIAHQEVLLKKGMIHLLLNDILFYQRPLKIKKSLIDNCPYENYKYVDKKSGDIKVKSIKCIAKSNPFFQEFRLWQFVSNLRLYRKSDDKDVTSEHLVTTDDYANLFTYLNNRKDIKQSVLLKEYFKIKKVKTINGAEYPVRWNYIDDDNKTYPCNETRYDILHALSKTELKSEWLTPERTYRLWHLLYSIESKEETKKALNKLNLSDDFTEAFLTIKPFKKEYGSYSEKAIKKLLSLMRMGYLWSEDEAIKQVGAEIEKTIEGELPDYVLQRLEKSQHNYNKISDFSGLPLWLASYIIYGRHSEAKEIIHWDNPESMMAYIKDFRQHSMRNPIVEQCVLETLRTVHDIWKEIGHIDEIHIELGREMKSTSEQRKAITQNVLHNQNTNIRIKLLLQELKNDNNITGVRPYSPMQQEILRIYEEGALQGLTKEDKDYNDILKISQTAQPTSNELTRYKLWLEQKYRSPYTGKAISLSKLFTSAYQIEHVIPQSRYFDDSLSNKVICESEVNTLKKAMLGMEFIKTCGGQKVHCTLLGDVEIYNEEDYKAFVNEHYSNNRTKRNKLLMEDIPQEFINRQLNDSRYISKMVKQLLSAIVRGQEEVEATSKFVIPCTGGITDRLKKDWGLNDIWNNLVSPRFQRMNALTGSEYFGHWENKEGKRVFQTTMPIQLQQGFSKKRIDHRHHAMDALVIACASRNIISYLNNETAQDTERRRDLRQKLCDKGGSVRKPWDSFTQDTQYALKDIIVTFKNYVRIINKATNYYEHYKTDGKKGMISQKGDELWAIRKPMHKETVFGKVNLRRPKRVSLSKAIDSVDVICNRKLKKYIKARLNEGLQKKQILNIFKELNNVWEGIDVNKIDIWEMSNDKEPMVATRKQLDTSFDEKKIRSISDTGIQKILLNYLITKNNNPELAFTPEGIQEMNSNISEYNDHKEHQPIYKVRVTEPLGAKYPIGTMGNKPKKFVEAQAGTNLYFAIYEDKEGNRNYDTIPLNIAAERLNQQLSPVPETNENNTPLKFYLSPNDLVYVPSEEERHSGNNIQLDKNRIYKMVSSTSKQCFFIHHRVAISLVDKKEFSAQNKMERSIDNEQVMIKSVCWKLITDRLGNIIKVIK

SEQ ID NO: 1293 - protein, 1486 aa, Artificial Sequence
  Cas9
MTKILGLDLGTNSIGWAIREDENEGVNQIIDKGVRIFSEGVKSENGKEISRAAERTAYRSARKIKYRRKLRKYETLKVLSVNGMCPLSVEEVEQWKKSGFKEYPLNPEFLNWLRTNEDKNINPYFFRDKASKQKVTLFELGRALYHIAQRRGFLSNRLDQSAEGVFEEHNPQIQNLIEDLDSSNTILNELKEYYINLGIIDESEKSGFKKDLDEGEKNLKKLYTSLVSITKKNANDIETCKQELIARLNKKEDLGKVKGEIKDISQAMLDGNFKTLGQYFFSLYNKTRIRNQYTSREEHYLEEFIIICQTQGIEEINTNEKLPEKKFTGLAKDLYRAIFFQRPLKSQKGLIGKCSFEKNKSRCAVSHPDYEEFRMWSYLNTIKIGTQSEKTLRFLTLEEKLKLVPKFYRKNDFNFEVLAKELVEKGASFGYYKSSKKNEFFYWFNYKPTDSVSACVVSASLENAIGKDWKTKTFEYQTSNTKKEEVTKSVNYKDLWHLLSVATSDTYLYDFAIEKLKLEPKNAKAFSKTKLKKDFASLSLAAIAKILPYLKQGLLYSHAVFIANIENIVDADIWKDKEQQKFIQSKIVDLIDNYLVEKSKLEIINCLLKIYNTEDIEGRKVYYSKEAESLFEADLRKKLVPFYKANTISEQQEQEIIFKDLFPVLIEQLKKQEFIKIVRLDKKIEAFLKGENEEGQIFCNYPEKFKKLYHPSDIEVFKKKIIKDEWGNEKVVLGSPLTTSIKNPMAMRALHQLRKVLNTLILDGQIDEKTRIHIEMARELNDANKRKGIQDFQKEREELYKIYEAKIKELYQVKTGKELLHVTDEDLQKFEWALEQTKDGRIITKEELIKYKIWEEQNHICIYTGKTISIDSFLGGNPKFDIEHTIPRSISQDNSLMNKTLCDKDFNRSVKGKKMPVELSNYNEILPRIAHWKKQAEELTRQIETISRSIKSAATKVAKDKNIRKRHYLTLKRDYIQGKYDRFTWGEPKVGFKNSQIPDTGIITKYAQAYLKSYFKRVESVKGGAVAEFRKLWGIQESFIDENGFKHFKEKDRSKHTHHTIDAITIACMPKDKYDLLAHAWRLEDEQNKKAAKALIEQAKPWKTFKEDIEKIEAEILVSHFTPDNVKKQAKKILRVRGKKQYVAEIERNANGKAIPKKDASGKIIYKLNERGNKIPILQQGDTIRGSLHQDSIYGAIKNPLNTNEIRYVIRKDLESLKANDIENIVDENVKAKVKEAVANKILLISSNPQQKNKFAEGKNVWMNEEKKIPINKVRIYANSVKNPIEIKKHSTLSKSKHEHKQTVYGQNDENYAMALYELDGKREFELINNFNLAKLLKQGQGYYPLHKEKEIKGKKVLIPIEKRNNRDVVLKRGQQVVFYDKTVENSKDISEIVDFRGRVYLIEGLTIQRQKDKKTGKVNEYGIIQLRYFKEARKSEEISKDSFKPDGEFKINENKPTRKMNHNQFTAFVEGIDFKVLPSGKFQKI

SEQ ID NO: 1294 - protein, 1487 aa, Artificial Sequence
  Cas9
MKNVLGLDLGSNSVGWALVKTEDNGNPIGSIKMGSRIIPMSQDILGSFEKGDTVSQTAQRTLYRGKRRLIERHVLRRERLCRVLHIMNFLPDHFDKLLGWDKTDNKTYGKFIDDSEPKLAWRQNKNEKEKMEFVFMDSFHEMLSDFAKHQPQLIANGKKVPLDWTIYYLRKKALTQLISKEELAWILLNFNKKRGYYQLRGEEEEEQPTKKEEYKVLKVISVDADEGQKGNGIWYNIHLEDGGIYKRKSDTPLYDWVGKTLQLIVVTIYEKDGKTPKIFDSGKQNPSYRLPKEDDWGLIKKRTESQIQSSGKTVGAFIYDNILSKPDDKIRGNLVRTIERKYYKKELIEILQQQAKYHDELHNQNLLESCAKELYAHNDVRYNEVVKSNMIHLLVDDIIFYQRPLKSKKSLIANCKYESYEYVDKETGEVKEMPIKCIAKSNPYYQEFRLWQFIHNLRLSDVVTREDVTAQYLSTPQDYCNLFTYLNDRKEIKQDILLKDFFKIKKVQIDKEKVFPIEWNYIKDATKTYPCNETRYELLSALKRAGMDKQWLDDTPNMQYRLWHLLYSVEEQEESAKALRKLYDNDNFVSSFLKIKPFKKCYGAYSEKAIKRLLTLMRMGKAWDEQAIDAKTLKCIQQIITGNIDSKLKEKIDDSRYVLHHVSDFQGLPTYLASYVIYGRHSEVTDIRCWDTPKDLLKFICGFPQHSLRNPIVEQVILETLRVVYDIWKAEKHIDEIHVEVAREMKLTAQQRNEANLRNLNNEATNLRIKYLLEELKNDTFIKDVRPLSPMHQEKMRIYEQAVLGNLNKQDKDYDDIIKISKKERPTSAELIRYKLWLEQKYCSPYTGKAISLSKLFTTAYQIEHVIPQSRYFDNSFNNKVICESEVNKEKDKMLGYEFIKGRGGDRIYCTAHGKEVTILKEEEYKQFVNEHYAHNKRKRDNLLAENIPESFSSRQLNDTRYITKTIMSLLSNVVRQQGEEEATAKNLLPSSGAVTDKLKNDWGLKDVWNTIVTPRFERLNKLSGTNDFGEMKEENGNRYFQTNVPSEYEKGFKKKRIDHRHHAMDALVIACTTRNMVNYISNVNANSPKQREDLRQLLCDKNRIINKPWNTFTQDALKALNDIVVSFKNNVRIINRATNRYQRYDKNGKKMICSQKGNDMWAIRKSMHKETVFGRVNLIRKEALPIAKALDNISAICNAQLRAYVNDLVDKHFNKKQLVAHFKSLDYKWNRQDVSKVEVWISSDDKTPMVAVRKPLDTSFDKKKIASITDTGIQAILLNYLESKGGDALVAFAPEGIQEMNSNIELYNNGKAHKPIKNVRLSETLGAKYQVGERGAKTKKYVVADKGTNLFFAIYEDEEGKRYYYSVPLREAIERQKQKLSPVPEYNEKGVALKFYLSPNDLVYVPTEEERTMGTCHIDKTRIYKMVSSSENRCCFVPSTIAKVIADKVELLSHNKIEKAITGESIKEVCWKLKVDRLGNILNVIK

SEQ ID NO: 1295 - protein, 1487 aa, Artificial Sequence
  Cas9
MKNVLGLDLGSNSVGWALVKTEDNGNPIGSIKMGSRIIPMSQDILGSFEKGDTVSQTAQRTLYRGKRRLTERHVLRRERLCRVLHIMNFLPDHFDKLLGWDKTDNKTYGKFIDDSEPKLAWRQNKNEKEKMEFVFMDSFHEMLSDFAKHQPQLIANGKKVPLDWTIYYLRKKALTQLISKEELAWILLNFNKKRGYYQLRGEEEEEQPTKKEEYKVLKVISVDADEGQKGNGIWYNIHLEDGGIYKRKSDIPLYDWVGKTLQLIVVTIYEKDGKTPKIFDSGKQNPSYRLPKEDDWGLIKKRTESQIQSSGKTVGAFIYDNILSKPADKIRGNLVRTIERKYYKKELIEILQQQAKYHDELHNQHLLESCAKELYAHNDVRYNEVVKSNMIHLLVDDIIFYQRPLKSKKSLIDNCKYESYEYVDKETGEVKEMPIKCIAKSNPYYQEFRLWQFIHNLRLSDVVTREDVTAQYLSTPQDYCNLFTYLNDRKEIKQDILLKDFFQIKKVQIDKEKVFPIEWNYIKDATKTYPCNETKYELLSALKRAGMDKQWLDDTPNMQYRLWHLLYSVEEKEESAKALRKLYDDDNFVSSFLKIKPFEKCYGAYSEKAIKRLLTLMRMGKAWDEQAIDAKTLKCIQQIITGNIDSKLKEKIDDSRYVLHHVSDFQGLPTYLASYVIYGRHSEVTDIRCWDTPKDLLKFICGFPQHSLRNPIVEQVILETLRVVYDIWKAEKHIDEIHVEVAREMKLTAQQRNEANLRNLNNEATNLRIKYLLEELKNDTFIKDVRPLSPMHQEKMRIYEQAVLGNLNKQDKDYDDIIKISKKERPTSAELIRYKLWLEQKYCSPYTGKAISLSKLFTTAYQIEHVIPQSRYFDNSFNNKVICESEVNKEKDKMLGYEFIKGRGGDRIYCTAHGKEVTILKEEEYKQFVNEHYAHNKRKRDNLLAENIPESFSSRQLNDTRYITKTIMSLLSNVVRQQGEEEATAKNLLPSSGAVTDKLKNDWGLKDVWNTIVTPRFERLNKLSGTNDFGEMKEENGNRYFQTNVPSEYEKGFKKKRIDHRHHAMDALVIACTTRNMVNYISNVNANSPKQREDLRQLLCDKNRIINKPWNTFTQDALKALNDIVVSFKNNVRIINRATNRYQRYDKNGKKMICSQKGNDMWAIRKSMHKETVFGRVNLIRKEALPIAKALDNISAICNAQLRAYVNDLVDKHFNKKQLVAHFKSLDYKWNRQDVSKVEVWISSDDKTPMVAVRKPLDTSFDKKKIASITDTGIQAILLNYLESKGGDALVAFAPEGIQEMNSNIELYNNGKAHKPIKNVRLSETLGAKYQVGERGAKTKKYVVADKGTNLFFAIYEDEEGKRYYYSVPLREAIERQKQKLSPVPEYNEKGVALKFYLSPNDLVYVPTEEERTMGTCHIDKTRIYKMVSSSENRCCFVPSTIAKVIADKVELLSHNKIEKAITGESIKEVCWKLKVDRLGNILNVIK

SEQ ID NO: 1296 - protein, 1487 aa, Artificial Sequence
  Cas9
MKNILGLDLGSNSVGWALVKVEENGNPIGSIKMGSRIIPMSQDILGSFEKGDTVSQTAQRTLYRGKRRLIERHVLRRERLCRVLHIMNFLPAHFDRLLGWDKTDNKTYGKFIDDSEPKLAWRQNKNEMGKMEFVFMDSFHEMLSDFAKHQPQLIANGKKVPLDWTIYYLRKKALTQLISKEELAWILLNFNKKRGYYQLRGEEEEEQPTKKEEYKVLKVISVDADEGQKGNGIWYNIHLEDGGIYKKKSDIPLYDWVGKTLQLIVVTTYEKDGKTPKIFDSGKQNPSYRLPKEDDWGLVKKRTESQLQSSGKTVGAFIYDNILSKPDDKIRGNLVRTIERKYYKKELIEILQQQAKYHDELHNQNLLESCAKELYAHNDVHYNEVIKSNMINLLVNDIIFYQRPLKSKKSLIANCKYESYEYVDKETGEIKEMPIKCIAKSNPYYQEFRLWQFIHNLRLSDVVTREDVTAQYLSTPQDYCNLFTYLNDRKEIKQDILLKDFFKIKKVQIDKEKVFPIEWNYIKDATKSYPCNETRYELLSALKRAGMDKQWLDDTPNMQYRLWHLLYSVEEKEESAKALRKLYDDDKFVTSFLKIKPFNKCYGAYSEKAIKRLLTLMRMGKAWNEQAIDAKTLKCIQQIITDNVDSKLKEKIDDSRYVLHHVSDFQGLPTYLASYVIYGRHSEVTDIQCWDSPEDLLKFIRDFKQHSLRNPIVEQVILETLRVVYDIWKAEKHIDEIHVEVAREMKLTAQQRNEANLRNLNNEATNLRIKYLLEELKNDTFIKDVRPLSPIHQEKMRIYEQAVLGNLNKQDKDYDDIIKISKKEHPTNAELIRYKLWLEQRYCSPYTGKAISLSKLFTTAYEIEHIIPQSRYFDNSFNNKVICEAEVNKAKGNMLGYEFIKKQGGQKIYCTQLGKAVTILKEEAYKQFVNEHYAHNKRKRDNLLAENIPESFSSRQLNDTRYITKTIMSLLSNVVRQQSEEEATAKNLLPSSGSVTDRLKNDWGLKDVWNTIVTPRFERLNKLSGTNDFGEMKEENGNRYFQTNVPLEYEKGFKKKRIDHRHHAMDALVIACTTRNMVNYISNANANSPKQREDLRQLLCDKNRIINKPWDTFTQDALKALNDIVVSFKNNVRIINRATNRYQRYDKNGKKIIFSQKGDDMWAIRKSMHKETVFGRVNLIRKEVLPIAKALDNISAICNAQLRAYVNDLVDKHFNKKQLVAHFKSLNYKWNRQDVSKVEVWISSDNKTPMVAVRKPLDTSFDKKKIASITDTGIQTILLNYLESKGGDASVAFAPEGIQEMNSNIELYNNGKAHKPIKNVRLSEPLGAKYQVGERGAKTKKYVEADKGTNLFFAIYEDEEGKRYYYSVPLREAIERQKQKLSPVPEYNEKGVALKFYLSPNDLVYVPTEEERTMGTCHIDKARIYKMVSSTGCSCYFVPSTFAKVIVDKVELQSLNKMEKAITDECIKEVCWKLKVDRLGNIINVIK

SEQ ID NO: 1297 - protein, 1494 aa, Artificial Sequence
  Cas9
MKNILGLDLGTNSIGWALIDNESHRIIKSGSRIIPMDAATMGDYEKGNLKSADWKRTSFRGMRRLYERAKLRRERLLRVLNILGFLPEEFRRQIDFEHHPGQFIDGKEPLIAYHHDENGQRVFSYMSAFEEMLTDFRATQSELVRDGRRVPYDWTIYYLRHKALTQPVTKEELAWIILNFNTKRGYYQLRSESEEVTTNKNEEYAELKVVSVEKTGEDKKRAGYYWYTITYDNEAEQKITSTIPPRQIGDKVELIVTTARDKAGEIKKSVRSPKEDDWTLMKKRTEHNIEEEECTVGSYIYQHILADPTVKVRGKLVHTIERKFYKKELKQILNKQKEFIPELQDASLYEACIKELYRNNEAHIQSIANKDFTDLFVNDIIFYQRPLKSKKSTISNCPYESYYYKNKETGELIRKPIKCIAKSNPLYQEFRLWQFVHNLRIYKKSEEVSGRLQTDVDVTDRFLTTPDDYAKLFSWLNDRKEIKQKELLRYEAFGLSKSYGDYRWNFVEDKPYPCNETLHEINRRMKSILSDKKLSSEAYQQLWHILYSIDDPIEIRKALTSFAQNQEINSDDFVNAFYQYVPEKTKSYGAYSEKAIKKLLPLMRRGSYWAIGNIDEKTHRRLDNIINGVADDSISTCTREKLNNLTDITMCQGMPLWQACYAVYDRHSEAADTTKWEQPDDIDTYLSTELKQHSLRNPIVETVISETLRVVRDIWKAYGRPEEIHVELGRNLKQDAKSRKQDAIRMAENEQTNLRIRALLQELSNPECGVENVRPHSPSQMELLKIYENEVLQSTDDIPEEISNIIKDLGKTDSKKRPSLSDITKYRLWLEQKYQSPYTGHIIPLSKLFTPAYQIEHVIPQSRYFDDSISNKVICEAEVNKEKDRMLGYEFIINKGGSIVKGSFGQQFKIFDKVQYEDFVKQRYAHNKTKMKKLLMDDIPDGFIQRQLNDSRYMSKKIISILSNIVREDGEKEATSKHIIVTSGAITDRLKKEWGIKDVWNDIIAPRFKRLNKLTDSNNYGMETEKEGRQYFQINVPTELSTGLIKKRIDHRHHAMDAIIIACTTRNHVNFLNNSTAASDQKDIRRDLQHTLCTKTKTDSNGNYVWRFNKPWDTFTQDTRQELEGIIVSFKQNLRIINKMSNYYQHYVDGRKTISRQNKGDGWAIRKSLHKATVSGKVNLKRSKTVGFKEALNDWSAIKDKTSKAILQKIIAQYKNYDPKTIFKYFKDRNFKVEGKDFSKLEVYYNTSDKEPMSAHRVNIDTTFDEKEIRSITDTGIQKIMLKHLHTYDDAQGKTHPEAAFSPEGIEKMNQNIRMLNGGKDHKPIFKVRKAEILGMKFAVGERGHKDKKWVEADKGTNLFFAIYESEENKRSYSSIPLNEAIDRLKRGENIADERDQNGNKLLFVLSPMDLVYVPDPDDAHIDEVKGNNNIFKMVSCTGTECYFVPETYANVICKGKELESKNKVESYDGINIKKSCYKITVDRLGKVRKIFKG

SEQ ID NO: 1298 - protein, 1496 aa, Artificial Sequence
  Cas9
MKTILGLDLGTNSIGWAKVCVDDNGNYLRDIKLGSRIIPMSQDVLGNFDKGVTESQTSVRTGFRGVRRIRERSLLRRERLHRVLHVLGYLPPHYDSAIGWNKNEPSTYGKFLNHGEPKLAWEHKEDGSMRFLFMESFHEMMADFAKSQPSLVSDGKKIPLDWTIYYLRKKALSQPIRKEELAWLLLNFNQKRGYYQLRGEEDDDNPTKCEEYYELKVVGIEADEEGKNGNTWYNVKLENGWIYRRQSKIPLDDWIGKVREFIVTTEYEKDGITLKKDKNGDVKRSFRSPSEDDWGLRKKRTEKLLDSSKMTVGAFVYDHLLAEPSDKIRGKFIRTIERKYYKKELYAILCEQSKYHEELRSGDYLNKCAEELYKNNQPHRNSLLTKDLAYLLLEDLIFYQRPLKTKKSLIAECPYEAYKYVDKETGEIKRQGIKCIAKSNPYYQEFRLWQFISNLRLFNKADDKEVTADYLPTQDDYVRLFAYLNDRKEINQETLLKEFFKLKKITVNSEKVFPIRWNYIEDKEKKYPCNETRHELLLALDRARIDHSWLEKPGQEYRLWHLLYSVESKEETKEALRKLKDDDAFVESFLKVKPFKREYGAYSEKAIKKLLAVMRMGSLWRETDICDTTKGNITKILQGEIDEKLKEKISASVSSYNQLSDFQGLPVWLACYVVYGRHSEAAEIQHWKTPESLLAYINGFKQHSLRNPIVEQCILETLRTVHDIWKEVGHIDEIHVELGRNMKSTADQRARISENVLRNENTNLRIKSLLLELKNDPNIKDVRPYSPMQQEKLRIYEEGVLQELTKDDKDFTEITKISTMAQPSAKELQRYKLWLEQKYRSPYTGKSISLTKLFTSAYQIEHVIPQSRYFDDSFSNKVICESEVNSLKDNMLGYEFIKNHGGEIIHCTMLGDVKVLSESEYKAFVNDHYAHNKRKRENLLLEDIPQEFLNRQMNDSRYISKVVKALLSNIVRAEGEEEATSKFVVSCSGGITDRLKKDWGLNDVWNKIVYPRFERLNRLTGTEAFGQWENKDGKRVFQTAVPLELQRGFNKKRIDHRHHAMDALVIACTSRNIINYLNNESANNPKKREDLRQKLCDKNRTIRKPWETFTQDATAALEDVIVSFKNYVRIINKATNYYERYDVEGKKVIAEQRGDDMWAIRKPMHEATYYGRVNLRRKKKVNLRVALENISSICDNKLRIYINGLVEKGFNTKQILDKFKNTNDHFSMQKIDKVEIWQFTNEEEKLVATRKPLDTSFDTKKIASITDTGIQTILLNYLETKGGDSTIAFTPEGIVEMNQNISKYNNGKEHMPILKVRLYTKLGKKIPVGQTGCKAKQFVIAEAGTNLYFAIYEDEEGKRSYRTIPLNEVVERLKQGLSPVPEKNDKDVHLKFYLSPNDLVYVPIEDEHESLAKDHIYKFVDSSGTTANFIPHRSANVIFELNKKDAEKFCSGSIIQNEYGVGSSQSKNQKAITGEMIKAVCRKLEVDRLGNVIKVI

SEQ ID NO: 1299 - protein, 1498 aa, Artificial Sequence
  Cas9
MKHILGLDLGTNSIGWAVIRAHQDADGHTTLQDILAAGSRIIPMDAATLTDFDKGNARSGTAERTSFRSMRRRRERQLLRRERLHRVLMLLGFLPQHYANSLTRYGEFADNRECKLPWVKDESDGKYHFLFQDAFHEMCEDFRQLAPQWVADGKKVPYDWTLYYLRCKALSRKISKEELAWILLSFNQKRGYYQARDEEDEVTTNKLEEYYAGKVVRVDDTGERKGKNVYYDITLENGWVYRYAARIYPDWVGQVKEFIVTTTLNPDGTPKTDKAGEVKRSFRMPKDDDWTLIKKKKERDIDRSQETIGQYIYHALLKDPSQKIRGKLIGTVERKYYKDELRRILDRQIQFHPELRDRELYYACLQELYPSNVAFRNTLVNRDFTYLFLDDILFYQRPLKSKKSQISDCPYEEHFYTDKETGERISVPVKCIAVSHPLYQEYRLWQFIQNLRIYCREARIDGNLMIDWEVTNELLQTEEDKTALFDWLNDKESVKQPELVAFLLGGKANKKQIKAYRWNYMDDDTKGYPCNETRASLLKYLREAQTDSSFLTREREEALWHILYSISDKGELKSALGKFAVKHGLNERFVTVFSKFPPFKKDYGSYSAKALKKLLPLMRMGHHWQEASFIPSTRQRMEKFINGEYDDSIDKRTYEKLESLTEVSQYRGLPGWLACYVVYDRHSEGRDIERWTSPSDIDSYLAQFKQHSLHNPIVERVVLETLRTVRDIWKQVDHIDEIHIELGRNMKLPADKRRQMTEQAWKNEQTNLRIKALLLEFARPGYDIENVRPYSPYQQDQLRIYEEAVLGANECPDDISAILKKFNGLNPPTSAEVLRYKCWLEQKYRSPYTGRTIPLSKLFTSAYEIEHIIPKQRYFDDSFSNKVICESEVNKKKGAMLGYEFIKSYHGASITLNRGGTASIFSVEAYENFVKEHYAHNRGKMKKLLMDDVPDSFISRQLNDSRYISKLMKSILSNLVREEGEKEAISKNLIVCTGGITDRLKKDWGIHDVWNDIIFPRFKRLDEMDSSHTYITLNTHRHPIPSMPLEFQRGFSKKRIDHRHHAMDAIVIACATRNIVNYLNNESARHDAKTSRMDLQRLLCTANRKLIDKPWKTFTQDTCKVLEDMIVSFQRTLRIINKTKNYYLRFEDGKKRRVLQTKGDNWAIRKPLHKETFYGEINLRRIETLSLNKALERIPDIVERDLRKKLSELLSLGYNAKRIKGYFEEHKEEWSDVNLSKIKAYYFTKQKNKRYFAARTELDTSFNKDKIENKIADTAIQKILLQHLEAYGNDVEQAFSPEGIDTMNRNIRQLNGGRSHQPIYKVRVYEEATKFAVGRRGNKSTKFVEAAKGTNLFFAIYEISQVDGNGNRQTSRTFSSIPLNVAVERLKQGLPPVPEDEEGNAPKYVLSPNDLVYLPTEKELKRREIAMPIDKSRIYKMVSCTGKDCFFIPANTAVPIVDRYEYSSMNKIGRALTGEMIKEICLPLKIDRLGQIIEISTF

SEQ ID NO: 1300 - protein, 1501 aa, Artificial Sequence
  Cas9
MKKILGLDLGTNSIGWAVINKAENEGKDVLCGIEAAGSRIIPMDATIMGDFEKGNSVSQTKDRREHRSTRRLYERGKLRRERLNRVLSVMGFLPDHYVSQLDRYGKFLSNTEPKLAWVRNADCKYHFLFMDSFSEMLQEFKTNSPQYISEESKVPYDWTLYYLRKKALTHKVTKEELAWILLNFNQKRGYFQLRDESEEEKKPSKIRQYFEHQKVVDIIDTNEVYKGLKVLIVILANGISGKIFKKEIPDWIGVEKDIIVKVDIDKDGKDKFNEDGSLSCRFNIPTEAEWDTEWELIKQKTQNDLDASGKTVGEYIFDTLLRNPEQKIRGKLVRTIERRYYKEEINAILKKQKEFHPELSDRALYEKCVEELYPNNPAHRNMMLIHDLSYFLVNDILFYQRPLKSKKSLIDECPYESHLYIDKKSGERKPVAVKCIAKSHPLYQEFRLWQFISNLRIYQKTKEVGNSLKVDVDVTNEFLKGENDYVELFDWLNTKKEIKQEDFLKYKPFGFTKGNINNYRWNYVEDKIYPCNKTHYTILKGLEKADITFDEFISHDSLAEENLWHILYSVSSKEELKHALESFADKRGLSIKFVDAFINTPAFEKSYGAYSAKAIKKLLPLMRMGKYWKEENICDSTRERIDKIITGEYDENIRDRVREKSINLTDITLFRGLPLWLACYVVYDRHSEAGNTERWTSPSDIDHYIRKFKQHSLRNPIVEQIVLETLRTVRDVWTEVGGIDEIHVELGREMKNPSDKRRKMSLQMQENENTNLRIKALLAEFINPELGIENVRPYSPSQQDLLRLYEEGAWNSPEIDEKQVDEMLAILKKFNETDSSKRPTKSEIKRYRLWLEQKYRSPYTGTPIPLSKLFTTAYEIEHVIPRSRFFDDSLTNKVICESEVNKLKGNMLGYEFIKSHYGEKVQLSSGSEVQIFSVNDYEKFVKDHYSKNKAKMKKLLMDDIPEKFTERQMNDSRYISRLIVSLLSNIVREKGEQESISKNVLVCTGGVTDRLKNDWGVNDVWNKIILPRFKRMNEITDSTDYTSVNTSGHIIPAMPLHLQKGFNKKRIDHRHHAMDAIVIACAGRNIVNYLNNQSSKSDVSRHDLRNLLCEKDKSDRKELIIKPWDTFTQDVYSVLSSIIVSIKQNLRVINKTKNIYQRKEDGKVIISKQENNINWWAIRKPLHKETVSGEVNLRKETTISLKEAIDNPARIIDKDFKKKLRELILMGYNEKLIKKYFYDNNESWQDVNLKKIPAYYFTKDTNDRYFASRSLLDENFDKKKIENKVTDTGIRTILLRHLEVEGGDSKVAFSPEGLERMNKNIEILNGGKKHKPIYKVREYEKAEKFAVGMRGNKASKFVEAAKGTNLFFAVYDNGKKRSFATVPLNEVIRLQKEGLPSAPANEEGLLPKFVLSPNDLVYVPTEDELRSGLLPENPAPERIYKMVSCTGYQCFFIHFSVSGVLCDKKEFSSLNKMERAISGEMIKEICIPLKVNRLGKIMYNL

SEQ ID NO: 1301 - protein, 1501 aa, Artificial Sequence
  Cas9
MKTILGLDLGTNSIGWAKISIDDNGNYLRDIQLGSRIIPMSQDVLGKFDNGVTESQTAVRTGFRGLRRIRERSLLRRERLHRVLHVMGFLPPHYDSAIGWNKEEPSTYGKFLNHGEPKLAWERQGDGSMRFLFMDSFHKMMEDFAPHQPALVADGRKIPLDWTLYYLRKKALTQPIKKEELAWILLNFNQKRGYYQLRGEEEEENPTKREEYHELKVVSVEAAEEGKGGNTWYNVKLENGWIYHRPSKIDLSDWVGKTKQFIVTMEYEADGITLKKNKEGEVKRSFRVPDEDDWGLRKKRTESQLEASGKTVGAFIYDHLLAEPADKIRGNFIRTIERKYYKQELADILREQSKYHEELQSKKILADCAEELYRSNQPHRDSLLKKDMVYLLLTDLIFYQRPLKSKKSLIANCPYEYYEYVDKETGEIKRQGIKCVAKSNPYYQEFRLWQFVLNLRLYDRTEDKEVTAEYLPSKEDYARLFVYLNDRKEINQETLLKDFFKLKKVKQRSEKEFPVRWNYIEDKEKKYPCNETRHELLMALDRAGMERSWLDDTARQYRLWHLLYSIEVKDEAERALRKLKDDDEFVSAFLKVKPFKKDYGAYSEKAVKKLLAVMRMGSHWCEDDICKETKERIEHILQGDVEEKIKERMNHTAYSLGELSDFQGLPEWLACYVVYGRHSEATDIKHWKTPESLMAYINGFKQHSLRNPIVEQCILETLRTVHDIWKEAGHIDEIHVELGRSMKSTSDQRARMTENILRNENTNLRIKSLLMELKNDADIKDVRPYSPMQQEILRIYEEGALQELTKEDNDYEEIFKISKIPQPSAKELLKYKLWLEQKYRSPYTGKPISLSKLFTSAYQIEHIIPQSRYFDDSFNNKVICESEVNALKSNMLGYEFIKNHGGEIVHCTLLGDVKVQNESEYKAFVTEHYANNKYKKEKLLMEDIPQDFLNRHLNDSRYISKVVKTLLSNIVRTEDEMETTSKFVVSCTGGITDRLKKDWGLNDVWNSIVYSRFERLNELTKSDAFGRWENKEGKRVFQTSVPLELQRGFNKKRIDHRHHAMDALVIACASRNIINYLNNESANSPKKREDLRQQLCDKNRIIRKPWESFTQDARAALEDVVVSFKNYVRVINKTTNYYERYGADGEKTIAKQKNSEMWAVRKPMHEAKYYGRVNLQRKTEVRLKAALEDIPSICNKELRDYINRLVKSGLNARQLLAHFKSTDYCWNKQNVDKVEVWRFSDEKEPLVAIRESLDTSFDAKRIDTITDTGIQKILLNYLEAKGGDPAIAFTPEGIAEMNQNMALYNNGKMHQPILRVRLSKKRGKKYQVGQTGCKAKQFVISESGTNLYFAIYEDEDRNRTYNTIPLNEVAERLKQGLSPVPEKNEKEVPLKFYLSPNDLVYVPTEEEILMKECKLNKNRIYKFIDSSGTTANFVPHRSASLIYNVDKKLAEAFCNDEIIQNEYGVGSPQSKNQKALTGEMIKAVCWKLEVDRLGNIIRVIK

SEQ ID NO: 1302 - protein, 1504 aa, Artificial Sequence
  Cas9
MKNIVGLDLGTNSIGWAVVNGNINDDGSEQLVKIQASGSRIIPMDAAMIGDFNKGNSISQTAERTRLRGIRRLSERYLLRRERLHRILDILGFLPSHFARDLDRYGKIVKDKEPKLAWRKNEAGQFEFIFQNSFKEMLEDFKLNHPNLITDDKKVPYDWTIYYLRKKGLTSKISKEELAWILLNFNQKRGYYQLRGEEEEENKNKQVEFYALKVIAVEDSGEKKGKDTWYNVHLENGWIYRRTSNMPLDWVGKTKEFIVTTDLEKDGTPKKDKEGNIKRSFRAPKEDDWSLVKKKTEADIDQTHKTVGTYIYDTLLGNPSQKIRGRLVRTIERKYYKEELKLILDKQKEFHPELQDRALYAACVEELYTINEAHRNNIGNRDFTYLFLEDILFYQRPLKSKKSLIDNCPYEENHCLDKETGEIKFFPVKCIAKSHPLFQEFRLWQFIVNLRIYRKGLAQDVDVTNELLKTEEDYVALFDWLNGKKEIDQKAFLKYPPFGLKKEVENYRWNYVQDKSYPCNETRSLMLARLEKCDISIEFLTKENEEALWHILYSVEDKNEIVKALQKFADKHNLNASFVDVFQKFPSFKKEYGSYSAKAIKKLLPLMRMGKYWSEDSIDKGTRERMDKIITGEYDEKIENRVREKAIHLADISEFKGLPLWLVCYIVYGRHSESKEIAKWESPADIDSYLKSFKQHSLRNPIVEQIIIETLRVVRDIWKQVGNIDEIHVELGREMKNPADKRRKMTQQISENENTNLRIKYLLTEFLNPEYEVENVRPYSPSQQDILRIYEEGVLNSVSNLPEEISDILKKFTETDLKKRPSRSEVLRYKLWLEQKYRSPYTGEVIPLGKLFTPAYEIEHVIPQSRYFDDSFSNKVICEAEVNKLKSNLLGHEFIVKHHGEIVELPFGKKVKIFTVDEYEQFVKDNYSRTRGKMKKLLVDDIPEEFVARQLNDSRYISKVVKSLLSNIVREKGEEEAISKNVIPCTGGVTDRLKKDWGVNDVWNKIILPRFQRLNELTGTNKFTTMSLNNHEIPAMPLELQKGFNKKRIDHRHHAMDAIIIACANRNIINYLNNESATAKAELSRYDLQRLLCDKAKTDDNGNYKWVIRKPWASFTQDVHGVLEDIIVSFKQNLRVINKATNHFLHYNEEGKKIFVKQEKGDSWAIRKSMHKDTVFGEVNLRRIKTVALNEAMKNPQSIVVKDFKRKLLELLNLGFDAKRIKKYFEDNRETWSDINLSKITVYYFSKDTKDRFFATRKPLDTSFDRKKIENNITDTGIQKILLRHLELKDNNPDIAFSPDGIDEMNRNIIQLNNGKYHQPIIKVRWYEQADKFAVGQTGNKSSKFVEAAKGTNLFFAVYESNILDEKTNTIIKKRNYATIPLNVAIERQKQGLSVAPEEENGNDPIFVLSPNDLVYLPTTDELANGVVAQPLDKERIYKMVSCTGNEGHFIPARIANPILQTIELGSNNKAQKAWTDEMIKEICMPIKVDRLGNILESSSLHKK

SEQ ID NO: 1303 - protein, 1504 aa, Artificial Sequence
  Cas9
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNYPNLITDDKKVPYDWTIYYLRKKGLTSKISKEELAWILLNFNQKRGYYQLRGEEEEENKDKLVEFYALKVVAVEDSGEKKGKDIWYNVHLENGWVYRRTSNMSLDWVGKTKEFIVTTDLEKDGTPKKDKEGNVKRSFRAPKEDDWSLVKKKTEADIDQTHKTVGAYIYDTLLGNPSQKIRGRLVRTIERKYYKEELKLILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIINLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKSSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSYKK

SEQ ID NO: 1304 - protein, 1504 aa, Artificial Sequence
  Cas9
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNHPNLITDDKKVPYDWTIYYLRKKGLTSKISKEELAWILLNFNQKRGYYQLRGEEEEENKNKLVEFYALKVVAVEDSGEKKGKDIWYNVHLENGWVYRRTSNMPLDWVGKTKEFIVTTDLEKDGTPKKDKEGNVKRSFRAPKEDDWSLVKKKTEADIDQTHKTVGAYIYDTLLGNPSQKIRGRLVRTIERKYYKEELKQILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIINLRIYRKDLAQDVDVTNELLKTEEDYVALFDWLNGKKEIDQKAFLKYPVFRLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRARIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEILRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGLQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKVRWYEQADKFAVGQTGNKFSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSHKK

SEQ ID NO: 1305 - protein, 1504 aa, Artificial Sequence
  Cas9
MKRILGLDLGTNSIGWALIENDFNRKEGKIEALGSRIIPMSQDILGKFDSGVTVSQTAARTNYRGIRRLYQRDNLRRERLHRVLNILGFLPKHYAESIDFEDRLGQFKPETEVKLPYRKDSDDNYHFIFQESFNEMVEEFQFKNPSLFYTKANGEQSKIPYDWTLYYLRKKALSKKISKEELAWILLNFNQKRGYYQLRGEEEADSKDKLEEYHALKVSDVQATEDTNAKGTWYNVILENGWIYRRQSKDSLFDWKGKTREFIVTTSLEKGGAVKIDKEGNEKRSFRAVDSEKDWIAIKKKTENDLANAGTTVGVYIYETLLRNPDQKIRGKLIKTIERKYYLEELKAILAKQIQEHAELQNRSLYKDCIEELYQGNEAHKNNIKENGFDYLFLEDIIFYQRPLKSKKSTISNCPYESRVFIKDGKKEIQPIKCISKSNPIYQEFRLWQFIHNLKIYEKEAIDDGKTVINKDVTTEFLNTQEAYAALFEFLNDKAEISQNALLKYFKLSTNTHRWNNVEDKKYPCNETRSEFIKRLSKMDGIDLGKTLSPAFEKSLWHIIYSVKDKKQYVRALETFAMKNGLDINQFRENFEKFKPYDSAYGAYSEKALKKVLPLIRRGTYWKKDAIPAAVQERIVNIMKRIESVDFNLEKIENFADDDIPKQLLKSFAKGKDPMQGLNTYQACYAVYNRHSEVSDIQLWKSPEDITKYLDSFKQHSLRNPIVEQVVMETLRVVRDIWQYYGNGAKDFFSEIHVELGREMKNDKKTRERISKSITENENTNERIKNILKELMGDEALQGDIRPYSKGHQDILKLYEEGVFANAPETYKNIKIDDIEKIRKNNSPSKSDIVKYKLWLEQGYISPYTGSPIPLSRLFTTDYQIEHIIPRSRYFDDSMGNKIICESAVNEEKTNKTAYEFIKENAGRIIDLGQGKQVPLFDLEAYESHCRGYFKGNTKKLKFLLSEDIPEGFINRQLNDSRYISKVVTSLLSNVVREEGEQEATSKNLVPLVGTITSKLKKDWGLEAIWDDLIAPRFERMNQLTKSTDFRKEVIDGHGNRYFINTVPDDIKKGFSKKRIDHRHHALDALVIACTTKDHVNYITSLNTQRNNRSLVSKLRKIEEKTIKDKRTGQPKTIKIAKAYHKPWPNFTKETFEKLSKTVVSFKQNQRIINKTNNKTWGWEKVDGVMKKVLKKQEKRNWAIRKPIHKETYYGKVKGFDSPKGKITTATRKSLREITNERQLNTITDSGIKKILNNHLKTFIDESGKINFEPAFNQDGIDLLNKNIQQLNEGKNHQPIYKVRMYTHNTMFSVGDEGNKSTKYVIPESGTNLFFNVYWDEENNKRNFETVPLNRVIAFQKQTSHIPRKDRTDVPIDNTLGRFLFTLSPDDLVYLPTDEESESFTTFEIDSLNSKQVANIYKFVDGSGTTGNFVPAEAARVIANIKDKKVRSNFCKRNNLSDKQLIKNEFGLGSPQLKNQNSLDGRQIKSICWKLEINRLGKIIKVIK

SEQ ID NO: 1306 - protein, 1504 aa, Artificial Sequence
  Cas9
MKKVLGLDIGTNSVGWAVVNQNDKGEFLSIEKIGSRIIPMSQDVMDKFGAGQTESSTAQRTQYRGVRRLRERSLLRRERLHRVLHILHFLPQHYDAAIGWNKKENKTYGKFLPGVEVNIPWVATDQGHQFIFMDSYAEMLKDLKQHQPHLFEKSSTPVPLDWTIYYLRKKALTQAISKEELAWILLNFNQKRGYYQLRGEEVEDNTKREEFYALKVVKVELDKDNTSAKTWYKVHLENGFIYPCPSDTPIDSWVGMVKDFIVTTTLEKDGSEKRTADGEIKRSFRAPKEDDWTLLKKKTESELEKSGKQVGAFIYDTLLSNPDQKIIGGLIKTIERKYYKKELEQILETQQKFIAELSDKKLFQACAEELYPLNDSHRENLLERDFKHLFVQDIIFYHRPLKTKKSLISNCTYEYRTFYKNGEKQISPIKCIAKSNPLFQEFRVWQFVQNLRILQRQRSEGDSIKYNVDVTAEFLKDENDIANLFTWLNERKVIKQDQLLKSYFKLKVNKETKELDYRWNYVDDKNKEYPCNATRTHILSFLEKCKEEKRIEDDRFVYSLWHLLYSVVEPIELRGALAKFAEREHLHPSFVDVFAQFPPLEKEYGSYSEKAIKRLLPLMRMGDYWHEDKIDVKTKQRIQRIIDGEADDDITHRSREKVENLRSITDFKGLPLWKAGYVVYNRHSESGELTKWKTPHELSNYIQNEFKQYSLRNPIVEQIVLETLRVVHDLWVKHGDFSEIHLELGRDIKNSSDKRKRMAERQQENENSRQRVLEMLIDLKKEAAFADLNPYSPSQQEKLRIVEDGVLRSNIEIPKDIEKITKSAKPTSRELTKYRLWLDQKYRSPYTGQPISLAQLFTSKYEIEHVIPQAKYFDDSFTNKVICESEVNKEKGSMLAHEFILKNGGSTVNVGGRQVQVLKNDAYVELINRLYGKNNPVKAKKLLAEDIDEVVGDFSERQLNDTRYISRVVQKLLSNIVREEDEQESTSKHVIGCSGQVTTALKKDWGLNDIWNKIIQPRFERLNEMTATEDYGVWQSPNHFQIRVPEEIQKGFTKKRIDHRHHAMDALVIACATRSHINYISNRSGQDRNAKFETTRTDLRSKLCYKENSSGNNYNYIFNKPWDTFTQDAHRALENIVVSHKQNLRVLTKTNNYTQFINKDGKKDLQKQVKGDHFAVRKPMHQETIYGRVSIRSIKEVALKKALENWKQIVDRTLKDKIRELIGAYGKYDAQTILKYFKDRDYKFNNLKINRVEVYEYDHNCAAVRKSIGDDLTIKQIERITDESIRKILMNHLSNYDDNLKEAFSPEGLMEMNKNIKELNGGKNHQPIYKVRLFEDLGSKFPLGVSHNNPDKYAIAAKGTNLFFGIYEDQEGKRMFDSIPLNIVIDRLKEKKSPVPETYNESKLKFHLSPNDLVYVPTDEEQKQPELVDVDHLSDEQKGRVYKAVSFTGNRAFFVNHRVSKVIHDYVEFGTKNKIENDDDKRSLKHICWKLKVNRLGEITDVKR

SEQ ID NO: 1307 - protein, 1504 aa, Artificial Sequence
  Cas9
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNYPNLITDDKKVPYDWTIYYLRKKGLTSKISKEELAWILLNFNQKRGYYQLRGEEEEENKDKLVEFYALKVVAVEDSGEKKGKDIWYNVHLENGWVYRRTSNMSLDWVGKTKEFIVTTDLEKDGTPKKDKEGNVKRSFRAPKEDDWSLVKKKTEADIDQTHKTVGAYIYDTLLGNPSQKIRGRLVRTIERKYYKEELKLILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIINLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSYYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNKSATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKSSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSYKK

SEQ ID NO: 1308 - protein, 1504 aa, Artificial Sequence
  Cas9
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNHPNLITDDKKVPYDWTIYYLRKKGLTSKISKEELAWILLNFNQKRGYYQLRGEEEEENKNKLVEFYALKVVAVEDSGEKKGKDIWYNVHLENGWVYRRTSNMPLDWVGKTKEFIVTTDLEKDGTPKKDKEGNVKRSFRAPKEDDWSLLKKKTEADIDQTHKTVGVYIYDTLLGNPSQKIRGRLVRTIERKYYKEELKQILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIVNLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEITQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEILRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKFSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSCTGNEGHFIPARIANPILQTIELGSNNKAQKAWTDEMIKEICMPIKVDRLGNVLESSSSYKK

SEQ ID NO: 1309 - protein, 1506 aa, Artificial Sequence
  Cas9
MKTILGLDLGPNSIGWAKVEVDDEGNYLRNIKLGSRIIPMTQDMLGDFDKGVKVSQTAIRTDFRGNRRLIERHLLRRERLHRVLHALKFLPKHYEDAIGWDRNEPATYGKFVNNSEPKLAWERQEDGSMRFLFMESFNEMVADFAQNQPSLVSDGKKIPLDWTIYYLRKKALTRPIKKEELAWILLNFNQKRGYYQLRGEEEEDNLTKRKEYYKLKVVGVEADGAPKGGKTWYNIHLENGWTARCQSKIPLDDWVGKVKEYIVTTEYEDDGKTPKCDKEGKVKRSFKSPEKDDWQLIKTRTEKFIDDSNKTVGAFIYDYLLEKPFDKIRGKYIRTIERKYYKNELREILREQTKYHEGLHSLEALKICAEELYKNNQQHQEYLLKKDMTFLLLNDLIFYQRPLKSKKSLIADCPYEVYKYDDKLTGKKGQKKIKCIAKSNPYYQEFRLWQFIANLRLFSVTDGKEVTAEYLKTEEDYVRLFSFLNDRKDIKQETFLRSFLKLKKESIGSEKIYPIRWNYIEDANKSYPCNATRHELLLAFDRADIPRELLDVEEREYRLWHLLYSIEAKEETESALRKLKANKAFGDLNIDDAFVNSFLKIKPFEKEYGAYSEKAIKKLLAVMRRGSLWKEADICEATKQNIAKILQNDIDEKLKKKIEAAVSSFNKLSDFQGLPTWLACYVVYGRHSEAAQIQCWQSPEDLKTYINKFKQHSLRNPIVEQCLLETLRTVYDIWKDAGQIDEIHIELGRNMKSTAEQRARKTKDILRNENTNLRIKNLLVELKNDDKIENVRPYSPSQQEILRIYEEGALQELSKEDEMFEDISKISKMAQPSPTELSRYKLWLEQKYRSPYTGRVIPLSKLFTTAYQIEHIIPQSRYFDDSFNNKVICESEVNSLKDNMLGYEFIKECGGRIVHCTLLGDVKIFTKEEYKDFVTKHYIDNTYKRDKLLLEDIPQEFSARQLNDSRYISKMVQTVLSNIVRAENEQEATSKFVVSCNGAITNRLKKDWGLNDVWSSIVCPRFKRLNEITKTNAFGHWEDKAGKHVFQTTVPLELQRGFSKKRIDHRHHAMDALVIACASRNIVNYLNNESANSPEKREDLRKKLCDEKRKIRKPWKTFTQDAREALSDVVVSFKNYVRVINKATNYYEHYSSSGNKVMISQKGNDMWAIRKPLHKESVFGRVNLCRKVIVSLKKALENIPAICDKTLRDYINALVEKHFNTRQLLAHFKSINYRLNRQCVEKVEVWQFSDEKIEMVARRKSLDTSFDDKQISSITDTGIQKILLNYLQTKDGNAEIAFTPEGIEEMNKNISLYNDGKAHQPILKVRVATPKGMKYPVGQTGNKATKFVVAEKGTNLYFAIYENELGVRSYDTIPLNIVVERLKEGLSPVPQANEADIPLKFYLSPNDLVYVPTKENEDELCRDRIYKFVDSSGTTANFVPHTSANTIYNVDKEYAEKCCNGAVFLNEYGLGSPQSKNQRALTGEMIKEICWKLKVDRLGNIIKVIK

SEQ ID NO: 1310 - protein, 1509 aa, Artificial Sequence
  Cas9
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNHPNLITDDKKVPYDWTIYYLRKKGLTSKISKEELAWILLNFNQKRGYYQLRGEEEKKNDNVMIINSKVIDVVKAEKDKKYEKYWYNVLLENGLLYRAAFYNDISFWKGHTKEFVLKTIKLKSGGTKQELSFLPSFDEIEKMEKKQKDKMYFKIKLKTEADIDQAHKTVGTYIYDTLLGNPSQKIRGRLVRTIERKYYKEELKLILDKQKEFHPELQDRALYAACIEELYPINEAHRNNVGNRDFTYLFLEDILFYQRPLKSKKSLIDNCPYEENQGLDKETGEIKSFPVKCIAKSHPLFQEFRLWQFIVNLRIYRKDLAQDVDVTNELLKTEEDYVALFDWLNGKKEIDQKAFLKYPVFGLKKEIENYRWNYVQDKPYPCNETRLLMLARLEKCDISIEFLTKENEEALWHILYSVEDKNEIVKALQKFADKHDLNASFVDVFRKFPPFKKEYGSYSAKAIKKLLPLMRMGKYWSEDSIDKGTRKRMDKIITGEYDEKIENRVREKVIHLADVSDFRGLPLWLVCYIVYGRHSEAKEITQWKSPADIDSYLKSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEILRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRGKMKKLLMDDIPEEFVARQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKLLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKFSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSCTGNEGHFIPARIANPILQTIELGSNNKAQKAWTDEMIKEICMPIKVDRLGNVLESSSSYKK

SEQ ID NO: 1311 - protein, 1509 aa, Artificial Sequence
  Cas9
MKRILGLDLGTNSIGWSLIEHDFKNKQGQIEGLGVRIIPMSQEILGKFDAGQSISQTADRTKYRGVRRLYQRDNLRRERLHRVLKILDFLPKHYSESIDFQDKVGQFKPKQEVKLNYRKNEKNKHEFVFMNSFIEMVSEFKNAQPELFYNKGNGEETKIPYDWTLYYLRKKALTQQITKEELAWLILNFNQKRGYYQLRGEDIDEDKNKKYMQLKVNNLIDSGAKVKGKVLYNVIFDNGWKYEKQIVNKDEWEGRTKEFIITTKTLKNGNIKRTYKAVDSEIDWAAIKAKTEQDINKANKTVGEYIYESLLDNPSQKIRGKLVKTIERKFYKEEFEKLLSKQIELQPELFNESLYKACIKELYPRNENHQSNNKKQGFEYLFTEDIIFYQRPLKSQKSNISGCQFEHKIYKQKNKKTGKLELIKEPIKTISRSHPLFQEFRIWQWLQNLKIYNKEKIENGKLEDVTTQLLPNNEAYVTLFDFLNTKKELEQKQFIEYFVKKKLIDKKEKEHFRWNFVEDKKYPFSETRAQFLSRLAKVKGIKNTEDFLNKNTQVGSKENSPFIKRIEQLWHIIYSVSDLKEYEKALEKFAEKHNLEKDSFLKNFKKFPPFVSDYASYSKKAISKLLPIMRMGKYWSESAVPTQVKERSLSIMERVKVLPLKEGYSDKDLADLLSRVSDDDIPKQLIKSFISFKDKNPLKGLNTYQANYLVYGRHSETGDIQHWKTPEDIDRYLNNFKQHSLRNPIVEQVVMETLRVVRDIWEHYGNNEKDFFKEIHVELGREMKSPAGKREKLSQRNTENENTNHRIREVLKELMNDASVEGGVRDYSPSQQEILKLYEEGIYQNPNTNYLKVDEDEILKIRKKNNPTQKEIQRYKLWLEQGYISPYTGKIIPLTKLFTHEYQIEHIIPQSRYYDNSLGNKIICESEVNEDKDNKTAYEYLKVEKGSIVFGHKLLNLDEYEAHVNKYFKKNKTKLKNLLSEDIPEGFINRQLNDSRYISKLVKGLLSNIVRENGEQEATSKNLIPVTGVVTSKLKQDWGLNDKWNEIIAPRFKRLNKLTNSNDFGFWDNDINAFRIQVPDSLIKGFSKKRIDHRHHALDALVVACTSRNHTHYLSALNAENKNYSLRDKLVIKNENGDYTKTFQIPWQGFTIEAKNNLEKTVVSFKKNLRVINKTNNKFWSYKDENGNLNLGKDGKPKKKLRKQTKGYNWAIRKPLHKETVSGIYNINAPKNKIATSVRTLLTEIKNEKHLAKITDLRIRETILPNHLKHYLNNKGEANFSEAFSQGGIEDLNKKITTLNEGKKHQPIYRVKIFEVGSKFSISEDENSAKSKKYVEAAKGTNLFFAIYLDEENKKRNYETIPLNEVITHQKQVAGFPKSERLSVQPDSQKGTFLFTLSPNDLVYVPNNEELENRDLFNLGNLNVEQISRIYKFTDSSDKTCNFIPFQVSKLIFNLKKKEQKKLDVDFIIQNEFGLGSPQSKNQKSIDDVMIKEKCIKLKIDRLGNISKA

SEQ ID NO: 1312 - protein, 1509 aa, Artificial Sequence
  Cas9
MKTILGLDLGTNSVGWAVINSVIKEQAERIWIEMAGSRIIPMDAAVLGDFDKGNSISQTSERTRLRGVRRLRERQLLRRERLHKVLNILGFLPNHYLEYIDFEKHPGKFLSDAEPKLPWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQIKEFIVTTDLNPDSTPKLDKYGEVKRSFRAPKEDDWMLIKKRTEADIANTHKTVGAYIYDTLLQKPQQKIIGKLVKTVERKLYRDELSLILQKQCAFHAELQDRTLYARCVEALYPNNEVQRRNIANRDFVYLLMDDVLFYQRPLKTKKSLIANCPYEENEYVDRETGEIKKAPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSRLEKANVCIDFLSNEKEVALWHILYSVSDKQEIEKALRTFAAKNGLDESFVEAFKKFPPFKSEYGAYSAKAIKKLLPLMRCGKYWDVSSIDDTTKERIKKIVAGEYDERIAVKVRDKVMNLSDISCFKRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDMVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKMLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKSRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDAPTMIVDKRVKNKVFELLSYKYDKKRIEKYFKENAVLWKELDLARVAVYYFTEATTEPLVAVRKPLDSTFNEKKIKESVTDTGIQKILLNHLCTKEGKPDLAFSAEGIEEMNRNLLQLNNGKRHQPIYKVRVYEPRGNKFSVGVLGNKGTKWVEAAKGTNLFFAIYITEDGKRTYETIPLNMVIEREKQGLAPVPDKNEKGDKLLFWLSPNDLVYLPTEEELEFGRINEPIDRGRIYKMVSSSGNQCFFIPQSISNAIIPTKELGANNKAERSWDGAMIKNICIPVKVDRLGRIIEVKYRINE

SEQ ID NO: 1313 - protein, 1509 aa, Artificial Sequence
  Cas9
MKTILGLDLGTNSVGWAVINSVIKEQAERIWIEMAGSRIIPMDAAVLGDFDKGNSISQTSERTRLRGARRLRERQLLRRERLHKVLNILGFLPNHYLEYIDFEKHPGKFLADAEPKLAWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQVKEFIVTTDLNPDGTPKLDKYGEVKRSFRAPKEDDWMLIKKRTEADIANTHKTVGAYIYDTLLQKPQQKIIGKLVKTVERKLYRDELSLILQKQCAFHAELQDRALYARCVEALYPSNEVRRKNIANRDFVYLLMDDILFYQRPLKTKKSLIANCPYEENEYVDRETGEIKKTPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSSLEKANVCIDFLSNEKEVALWHILYSVSDKQEIEKALRTFAAKNGLDESFVEAFKKFPPFKSEYGAYSAKAIKKMLPLMRCGKYWDVSSIDDTTKERIKKIVTGEYDERISVKVRDKVMNLSDISCFRRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDTVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKLLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKNRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDTPAMIVDKRVKNKVFELLSYKYDKKRIEKYFKENAFLWKELDLAKVAVYYFTEATTEPLVAVRKPLDSTFNEKKIKESVTDTGIQKILLNHLCTKEGKPDLAFSAEGIEEMNRNLLQLNNGKSHQPIYKVRVYEPRGNKFSVGVLGNKGTKWVEAAKGTNLFFAIYITEDGKRTYETIPLNVVIEREKQGLVPVPDRNKKGDKLLFWLSPNDLVYLPTEEEREFGRINEPIDRGRIYKMVSCTGNEGHFIPANVANPIVPVIELGSNNKAQRAWTNEMIKDICIPIKVDRLGHIIEVKYRIDE

SEQ ID NO: 1314 - protein, 1509 aa, Artificial Sequence
  Cas9
MKKILGLDLGTNSVGWAVINSVVNDEGKEQLVNISSCGSRIIPMDAATLGDFDKGNSKSPVAERTRLRGVRRLLERSLLRRERLHRVLSVMGFLPEHYAAQLDRYGKFLPETEPKLAWYKDETGKYRFLFQDSFNEMLEDFHEHHPELVAEGKKIHYDWTIYYLRKKALSQKITKEELAWILLNFNQKRGYYQLRGEEEQEDNKKSVEYYALKVVAVEDSGDRKGKDIWYNVKLENGWVYRRASGVPLDWVGKVKEFIVTTDLDEKGNPKKDKDGNVKRSFRAPKEDDWGLLKTRTQAQIDESGQTVGTYIYESLLRMPDQKIRGKLVRTIERKYYKDELRKILIKQSEFHTALQDHNLLLACIEELYPNNEAHRRLLSTSDFTYFLVEDILFYQRPLKSQKGQIDDCPYESHVYRDKKDGSLQHVPLKCVSKSHPLFQEFRLWHFLSFLRIYQRERMIDGSLKLDVDVTNEFLQNEDDYVKLFDWLNERKEIDQKTILAYKPFGLKKNEQSKYRWNYVEDKSYPCNSTRADMIFRLSKAGVPEEFLTREKEEALWHILYSISDKKELTKALGTFAEKNGLNETFVEIFSKMPPFESDYAAYSLKAIRKLLALMRMGKYWDEQAIDEHTRSRIEKILTGEYDETIRTRVREKAMHLTDISSFRGLPLWLACYVVYDRHSEAKELVKWETPDDIDHFLRKFKQHSLRNPIVEQIIMETLRTVRDIWKQEGKIDEIHVELGREMKNPAKERARITAQVLENENTNLRIKALLAEFMNPEFEIENVRPYSPAQQEILRIYEEGVLSGVAEKDLPDDIASILKKFRENDVKKRPTTSEVLRYKLWLEQRYRSPYTGRIIPLGKLFTPAYEIEHVIPQSRYFDDSFTNKVICESAVNKLKDNCLGYEFVKKHSGEKVELGNGETATIFSVEEYERFVKDSYFNNSKKIKKLLLEDIPDNFIERQLNDSRYISKVVKSLLSNIVCEEGEQEGMSKNVIVCTGGVTDRLKKDWGVQDVWNRIILPRFLRLNKMTDRTDFTAVSTNGHLLPAVPLHLQKGFNKKRIDHRHHAMDAIVIACAGRNIVNYLNNASARKGSEISRYDLQHLLCDKVKTDANGNYKWILRKPWETFTQDLYAALTNIVVSFKQNLRVINRTTNHYQHYNEDGEKKMIPQTKGDRLAIRKPMHKDTVYGEVNLRKEKTLPLKDVVKNPSAVVDKSLKNKLYELLKSQYDLKAITKYFETHQDVWADVNLKKIKVYYFTKETNERFFATRKSLDSSFSQKKIEEEVTDTGIQKILLRHLQQNGNNPDIAFSPDGVERMNQNMTILNDGKWHQPIYKVRTYEKADKFAVGEKGNKVKKFVEAAKGTNLFFAVYESIQEDEATGKQVRKRTFATIPLNEVIKRKKQGLPAAPEDSKGNLPIFVLSPNDLVYLPTEEERNSGKIIQPLDRERIYKMVSCTEGECHCIPEYVANPILQTIELGSNNKAQRAWSGEMIKEICVPVKVDRLGNVSLIKI

SEQ ID NO: 1315 - protein, 1509 aa, Artificial Sequence
  Cas9
MKTILGLDLGTNSVGWAVINSVIKEQAERIWIETAGSRIIPMDAAVLGDFDKGNSISQTSERTRLRGARRLRERQLLRRERLHKVLNILGFLPNHYLEYIDFEKHPGKFLADAEPKLAWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQVKEFIVTTDLNPDGTPKLDKYGEVKRSFRAPKEDDWMLIKKRTEADIANTHKTVGAYIYDTLLQKPQQKIIGKLVKTVERKLYRDELSLILQKQCAFHAELQDRALYARCVEALYPSNEVRRKNIANRDFVYLLMDDILFYQRPLKTKKSLIANCPYEENEYVDRETGEIKKAPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSSLEKANVCIDFLSNEKEVALWHILYSVSDKQEIEKALRTFAAKNGLDESFVEAFKKFPPFKSEYGAYSAKAIKKMLPLMRCGKYWDVSSIDDTTKERIKKIVTGEYDERIAVKVRDKVMNLSDISCFRRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDTVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKLLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKNRTDDNGNYKWVIKKPWDTFTQDAREVLSKIVVSLKQNLRIINKTTNVYRHFDATVNRVYEKQKTGDSWAIRKPMHKDTVFGAVNLRKVKVVRLSVALDTPAMIVDKRVKNKVFELLSYKYDKKRIEKYFKENAFLWKELDLAKVAVYYFTEATTEPLVAVRKPLDSTFNEKKIKESVTDTGIQKILLNHLCTKEGKPDLAFSAEGIEEMNRNLLQLNNGKSHQPIYKVRVYEPRGNKFSVGVLGNKGTKWVEAAKGTNLFFAIYITEDGKRTYETIPLNVVIEREKQGLVPVPDRNEKGDKLLFWLSPNDLVYLPTEEEREFGRINEPIDRGRIYKMVSCTGNEGHFIPANVANPIVPVIELGSNNKAQRAWTNEMIKDICIPIKVDRLGHIIEVKYRIDE

SEQ ID NO: 1316 - protein, 1509 aa, Artificial Sequence
  Cas9
MKKTLGLDLGTNSIGWAVINSNIDSEGKEKLVGISSCGSRIIPMDATTLGDFGKGNTKSPVAERTRLRGIRRLLERSLLRRERLHRVLSVMGFLPEHYASQLDRYGKFLPETEPKLAWYKDDSGRYQFLFQKSFHEMLEDFRQHQPELVAGEKKIPYDWTIYYLRKKALSQEITKEELAWILLNFNQKRGYYQLRGEEEQEENNKSVEYHALKVVSVEDSGERKGKDIWYNVTLENGWVYRRASNIPLDWTGKVKEFVVTTELDDAGNPKKDKEGNVKRSFRAPKEDDWGLLKTRTQAQIDESGKTVGTYIYESLLCMPNQKIRGKLVRTIERKYYKDELRQILVKQSEFHAALQDHNLLLSCIEELYPNNEAHRRLLSASSFIYFLIEDILFYQRPLKSQKGLIDNCPYESHIYKDKKDGSLHHVPLKCVSKSHPLFQEFRLWQFLSNLRIYQRERMMDGSLKLDVDVTREFLPSEEDYVKLFDWLNERKEISQKFLLAYKPFGLKKNEQANYRWNYVEDKSYPCNETRAEIKSRLSKAGVPEEFLTEEKEEALWHILYSISDKKELTKALGTFAAKNCLNESFVEVFAKIPPFESNYAAYSLKAIRKLLALMRMGKYWNEQAIDRQTRDRIEKILTGEYDETIRSRVREKAMLLTDISSFRGLPLWLACYIVYDRHSESKELVKWETPADIDHFLSKFKQNSLRNPIVEQVITESLRTVRDIWKQEGKIDEIHVELGREMKNPAKERARITAQVQENENTNLRIKALLAEFMNPEFEIENVHPYSPGQQEILRIYEDGVLSGIAEKDLPDDITAILKKFRENDVKKRPTTSEVLRYKLWLEQRYRSPYTGRVIPLGKLFTPAYEIEHVIPQSRYFDDSISNKVICESAVNKLKDNCLGYEFIKKHSGEMVELGNGETVPVFSVEEYERFVKESYFGNSKKMKKLLLEDIPDSFIERQLNDSRYISRVVTSLLSNLVCEEGEQDGLSKNVIVCTGGITDRLKKDWGVQEVWNRIILPRFLRLNEITGRTDFTSTSVNGHLLPALPLYLQKGFNKKRIDHRHHAMDAIVIACANRNIVNYLNNSSARKNSEISRYDLQRLLCEKVKTDANGNYKWILRKPWETFTQDVYAALTNIVVSFKQNLRVINRTTNYYQHYNEAGEKRMIPQTKGDRWAIRKPMHKDTVYGEVNLRKEKTLPLRDVVKNPSIVVDKSLKNKLYELLKSQYDLKAIAKYFETHQDVWADVNLKKIKVYYFTKETNERFFATRKSLDPSFDQKKIEEEVTDTGVQKILLHHLQQNNNDPDMAFSPDGIDRMNQNMTILNDGKWHQPIYKVRTYEKADKFAVGESGNKAKKFVEAAKGTNLFFAVYESVQEDEAIGKQVCKRTFATIPLNEVIKRKKQGLPAAPEDLNGNLPKFVLSPNDLVYLPTEEERNSSRIIQPLDRERIYKMVSSSGSQCFFIKVFVANSIWDKNEYSSLNKMERAITNEMIKEICVPIKIDRLGNVSLIQI

SEQ ID NO: 1317 - protein, 1510 aa, Artificial Sequence
  Cas9
MKRILGLDLGTNSIGWALVDSEEQRILGMGSRIIPMDQGVLDTFSGGNPVETQTAARTVYRGTRRLRERALLRRERLIRVLNMMKFLPEHYASQIDFEKRLGQFFDEKEPKLAWKQNDEGRFEFIFQQSFNEMIEEFKNKGVVREDKKIPYDWTIYYLRKKALSQEIEKEELAWILLNFNQKRGYYQLRGEEEEENPNKLVEYYSLKIVDVIADEKPNSKSDIWYSLHLENGWIYRRSSKIPLFGWKDKTRDFIVTTDLNDDGTVKKDKEGIEKRSFRAPSENDWVLLKKKTESDIEKSHKTVGAYVYETLLQNPMQKVRGKLVRTIERKFYKDELKQILEKQREFHPELRDEDLYNDCVRELYRSNETYQFILSKRDFVHLFLDDILFYQRPLRSQKSAIGDCILEFKTYKDKDGNNIKEYLKVISKSNPLYQEFRIWQWLYNLKIYRKEDDEDVTLQFIANIEDKEQLFDFLSNRKSIEQKPLLEYLIKAKGLKKQVKTEAYRWNYVEDKIYPCSETKTMISTRLAKVENIPDNFFTKEIEQKLWHIIYSVTDKNEFEKALRTFAKKYDLDIASFVDNFKKIPPFKNEYGSFSEKAIKKLLPLMRLGKYWKWNDIDNNTQNRISKIITGEYDEEIKDIVREKSIALTNENDFQGLQLWLAQYLVYGRHSEADIAGKWHSVADLEKYLNEFKQHSLRNPIVEQIITETLRVVRDIWRKYGQGAENFFSEIHVELGRDMKNTADERKKIVNVVTENENTNLRIKALLMELKNNSDGKLEVENVRPYSPTQQDILKIYEEYAISTGLDNEKDEKVKEDIKKISRVAQPTTTELQRYKLWLEQKYCSPYTGKVIPLGKLFTEEYQIEHIIPKSRYYDDSFSNKVICEAAVNKLKDKCLGLEFIKNYHGQIVETGFGQKVTIFDEEAYQNFVKQHYAYNHSKRTKLLLEEIPEKMIERQMNDTRYISKFVLPLLSNLVRAKENDNGVNSKNVLPVNGKITTMLKQDWGLNDVWNDLILPRFVRMNELAKTIAFTSWNEQHQKYLPTVPLELSKGFQKKRIDHRHHAMDALVIACATRDHVNLLNNKHANTDTIRYDLQRKLRLFERVTYIDPQTKNNVTKDIPKEFKKPWDNFTVDARNELEKIIVSFKQNLRIINKATNIYTKYENGKKIKVGQKGLNWAIRKPLHKETVFAKVSLRKRKTVRLSEALKDWKKIVDKKLKQEIKRLTCQYGKFDVDTILRYFKDRKYQFGEVDVSKVKMYYFDEENAAVRKNVDTSFTEKFIQGSVTDTGIQKILLNHLEAKGNKVEIAFSPEGIEEMNKNIIQLNEGKLHLPIFKVRVYETIGNKFSVGVKGNKKDKYVEAAKGTNLFFAIYVDENGIRSYETIPLNIVIERLKQGLSVVPEKNRKEHSLLFYLSPNDLVYVPIEDERENIHAVNLDQLNNEQRKRIYKMVSCTGSECHFVPYYVASPIVNKVEYSSLNKIGRSLTGEMIKDVCIKLKVDRLGNIKGISGL

SEQ ID NO: 1318 - protein, 1510 aa, Artificial Sequence
  Cas9
MKRILGLDLGTNSIGWALVDSEEQRILGMGSRIIPMDQGVLDTFSGGNPVETQTAARTAYRGTRRLRERALLRRERLIRVLNMMKFLPEHYASQIDFEKRLGQFFDEKEPKLAWKQNDEGRFEFIFQQSFNEMIEEFKNKGVVREDKKIPYDWTIYYLRKKALSQEIEKEELAWILLNFNQKRGYYQLRGEEEEENPNKLVEYYSLKIVDVIADEKPNSKGDIWYSLHLENGWIYRRSSKIPLFGWKDKTRDFIVTTDLNDDGTVKKDKEGIEKRSFRAPSENDWVLLKKKTESDIEKSHKTVGAYVYETLLQNPMQKVRGKLVRTIERKFYKDELKQILEKQREFHPELRDEDLYNDCVRELYRSNETYQFILSKRDFVHLFLDDILFYQRPLRSQKSAIGDCILEFKTYKDKDGNNIKEYLKVISKSNPLYQEFRIWQWLYNLKIYRKEDDEDVTLQFIANIEDKEQLFDFLSNRKSIEQKPLLEYLIKAKGLKKQVKTEAYRWNYVEDKIYPCSETKTMISTRLAKVENIPDNFFTKEIEQKLWHIIYSVTDKNEFEKALRTFAKKYDLDIASFVDNFKKIPPFKNEYGSFSEKAIKKLLPLMRLGKYWKWNDIDNNTQNRISKIITGEYDEEIKDIVREKSIALTNENDFQGLQLWLAQYLVYGRHSEADIAGKWHSVADLEKYLNEFKQHSLRNPIVEQIITETLRVVRDIWRKYGQGAENFFSEIHVELGRDMKNTADERKKIVNVVTENENTNLRIKALLMELKNNSDGKLEVENVRPYSPTQQDILKIYEEYAISTGLDNEKDEKVKEDIKKISRVAQPTTTELQRYKLWLEQKYCSPYTGKVIPLGKLFTEEYQIEHIIPKSRYYDDSFSNKVICEAAVNKLKDKCLGLEFIKNYHGQIVETGFGQKVTIFDEEAYQNFVKQHYAYNRSKRTKLLLEEIPEKMIERQMNDTRYISKFVLPLLSNLVRAEENDNGVNSKNVLPVNGKITTMLKQDWGLNDVWNDLILPRFVRMNELAKTIAFTSWNEQHQKYLPTVPLELSKGFQKKRIDHRHHAMDALVIACATRDHVNLLNNKHANTDTIRYDLQRKLRLFERVTYIDPQTKNNVTKDIPKEFKKPWDNFTVDARNELEKIIVSFKQNLRIINKATNIYTKYENGKKIKVGQKGLNWAIRKPLHKETVFAKVSLRKRKTVRLSEALKDWKKIVDKKLKQEIKRLTCQYGKFDVDTILRYFKDRKYQFGEVDVSKVKMYYFDEENAAVRKNVDTSFTEKFIQGSVTDTGIQKILLNHLEAKGNKVEIAFSPEGIEEMNKNIIQLNEGKLHLPIFKVRVYETIGNKFSVGVKGNKKDKYVEAAKGTNLFFAIYVDENGIRSYETIPLNIVIERLKQGLSVVPEKNRKEHSLLFYLSPNDLVYVPIEDERENIHAVNLDQLNNEQRKRIYKMVSCTGSECHFVPYYVASPIVNKVEYSSLNKIGRSLTGEMIKDVCIKLKVDRLGNVKGISGL

SEQ ID NO: 1319 - protein, 1511 aa, Artificial Sequence
  Cas9
MKKILGLDLGTNSIGWAVINSVADESVEKRNIELAGSRIIPMDAAVLGNFDNGVTKSQTAERTSYRSIRRLRERQLLRRERLHKVLQILGFLPEHYVNDIDFENHPGKIKKNTEPKLPWRKNSMGQFEFIFQASFEAMLTDFATHQPVFVSEGKKVHYDWTLYYLRKKALTEEISKEELAWIILNFNQKRGYYQLRGEEEEEQSNKLVEFYALRVVKVEATDDKKGKDTWYNVHLENGWIYRRTSNIPLDWEGKVKEFIVTTDLNEDGTPKLDKYGEVKRSFRAPKEDDWTLIKKKTESDIANSHKTLGCYIYDALLQNPNQKIKGRLVRTVERKFYKEELRLILEKQLSFHPELQDRDLYRACIDALYVSNEAHKNNISGRDFVYLFIDDIIFYQRPLKTKKSLIDNCPYEKNQYMDRETGEVKQAPIKCIAKSHPLFQEFRLWQFISNIRIYQRERVMDDGKLETDVDVTPDFLKTEDDYTTLFEWLNDRKEVDQKAFLKNPQFGLKKTFTEYRWNYVEDKSYPCNETRNAILNGLQKAGVSADFLSREVEEALWHILYSVEDKIEIESALRKFASKHDLDDRFADVFKKLPPFRKEYGAYSAKAIKKLLPLMRMGKYWELSNIDDKTKERIDKIITGEWDENIHNRVREKAIKLSDITDFKGLPLWLSCYVVYNRHSEARAIAKWESPEDIDSYLRLFRQHSLRNPVVEQVITETLRTVRDIWKRIGQIDEIHVELGREIKNPADKRAKMTAQIVENENTNLRIKALLAEFINSEYEIENVRPYSPGQQEILRIYEDTVLNSVEEIPEDISAVLKKFRESDLKKRPTKSEFLRYKLWLEQKYRSPYTGDIIPLGKLFTSAYEIEHIIPQSRYFDDSFSNKVICEAEVNKLKSNELGYEFIKNHHGQYVEIGFGKVVQIFSIEAYEKFVKANYSGIGSKMKRLLMDDIPETFIERQLNDSRYISKVVKSLLSNIVREKDSNGEYEPEAISKNVIVCTGSVTDRLKRDWGVNDVWNSIIYPRFERLNELTGSQQFGCWENKEGKRVFQTAVPLEMQKGFSKKRIDHRHHAMDAIVIACAIRNHINYLSNESASKKAKISRIDLQRLLCTKCRTDDNGNYKWIVKKPWPAFTQDIRKALENITVSFKQNLRVINKTTNYYVHFDESGKKVLEKQINGDSWAIRKPMHKDTVFGKVNLQKVKEVRLSLALDTPKMIVDKKLKEKVLQLYSYKYDKKRIDKYFKENASLWKDLNLSKVAVYYFTNDSTEPLVAVRKPLDTSFNAKKIKESVTDTGIQKILLNHLSNNQDNPNLAFSPDGIDEMNRNLTTLNDGKYHQPIYKVRVCEPQGNKFSVGTSGNKTSKYVEAAKGTNLFFAVYQTEDGKRNYETIPLNVVIEREKLEWAPVPENNNNGDKLLFWLSPNDLVYVPTADELNNGMRLDNMDKGRIYKMISCSGPQCFFIPQNVSNPIIPVIELGVNNKAEKSWNNEMIKVVCVPIRVDRLGCITQINNQK

SEQ ID NO: 1320 - protein, 1512 aa, Artificial Sequence
  Cas9
MKKILGLDLGTNSIGWALIENSFTEKEGKINDMGVRIIPMSADILGKFDAGQSHSQTAERTGYRGTRRLYQRDNLRRERLHRVLHILGFLPKHYDEHIDFEKRLGQFKEGKEIKLNYRCNVENKHEFIFISSFNEMLTEFKKAQPELFYLKSNGEETKIPYDWTLYYLRKKALSQPLTKQELAWIILNFNQKRGYYQLRGEEIDDDKNKQFVKLKVKEVINSGEAVKGKPLFDVIFENGWKYDKQVVKTEDWIDRTKEFIVTTKVLKNGDLKRSYKTVDSEKDWAAIKAKTEQDIERSNKTVGEFIYETLLENPTQKIRGKLVKTIERKFYKEELKNILIKQIELQPTLFSEELYKACIEELYPRNEAHQNAIKNRDFIYLLMDDIIFYQRPLKSQKSNISGCQLEQRVYYKANKDSGENEEVKQAVKAIPKSHPLFQEFRNWQWLQNLKIYNKVDTEKGELTDVTKQLLPSEDSWVNLFNFLQCKKELEQKQFIKYFIDKKLINKTEKDHYRWNYVEDKKYPFTETRAQFISRLTKVEGIEEINTFLDKKTQIGTKDNSPFVSRIEQLWHIIYSVSDIKEYESALEKFAIKHHLNEESFVANFIKFPPFKSDYGSYSKKALNKLLPLMRRGNYWTENDISEKVKLRVSEIMERVNALNLKEDYSSKELAETLVNVSDDDVKKQLIKSFVSFKDRNPLMGLNTFQATYLVYGRHSEVGDIQNWKTPDDIDTYLKNFKQHSLRNPIVEQVVTETLRVVRDIWKHHGKSQTNFFNEIHVELGREMKNPADKRKRISERNTENENTNNRIREILKDLMNDASIQGDVRDYSPSQQGILKIYEEGVYQNPKVDYSKVSEDEITKIRRSNNPTQKEIQRYRLWLEQGYISPYTCKPIPLSKLFTHHYQIEHIIPQSRYFDNSSSNKIICESEVNEDKDNKTAFEYLKDKGENVINGHKLLSLAAYEAHVNKYFKNNRQKLKNLLSEDIPEGFINRQMNDSRYISKLVKGLLSNIVREEGEQEVTSKNLIPVTGSVTSKLKNDWGLNDKWNELILPRFKRLNQLTQTNDFTTANTNGNTIPTVPDELLKGFSKKRIDHRHHALDALVVACCTRNHSNYLSALNTENKNYGLRDKLLIKNDNDHYTKSFQMPWHGFTTEAKNQLEETVISFKQNLRVINKANNKFWSYKDENGKLNLDKNGKPIKKLRKQTKGDNWAVRQPLHEETISGIVNLPWVKAEKEKFTYATRKSLDKSFDLKKIEKITDTGIQKILRNYLMQEKFKELDKKDKEVYNSELAFSQEGLEDLNSNIEQFNDQKPHKPIYKVRLFEKGSGRFALGFKGINAKKYAQGSPNLYFNIYRNEDGQYYETVPLNKVIIHQKNAANMPKKNRTPVPISNTAINRSKEVLVDYKMTLSPLDLVYIPTEEELNNINSLDFNNLSKSQRKRLYNVNDFSGYTIYFSPNTLAKSICPKEVDMKFDEKKQKPTGSFDSKTASLDGMSIKERCIKLIIDRLGNISKA

SEQ ID NO: 1321 - protein, 1512 aa, Artificial Sequence
  Cas9
MKKILGLDLGTNSIGWAVVNADEITRDDGSRYLKPNGISAAGSRIIPMSADILGDFEKGNSISQTAERTRMRMARRLHERALLRRERLLRVLNLLDFLPKHFADKIDRYGKFTDDSEPKLAWRKNTEGKYEFIFQDAFNEMLAEFKDKQPEIVEEGKKIPYDWTIYYLRKKALEKALSKEELSWILLQFNQKRGYYQLRGEEEEIPQDKKIEYLAQKVVKVEATDQKKGDDVWYNVYLENGMIYRRTSKAPLDWEGKVKEFIVTTEVENDGETPKKDKEGNIKRSFRAPKEDDWTLLKKKTEADIENSHKTVGCYIYDSLLNNPKQKIIGKLVRTVERKFYKEELTQILKKQVELIPELRDDNLYKQCIEELYPINEAHRNTIAKTDFANLFINDILFYQRPLKSKKSQIDNCPYEERIFIDSKTGEKKKVPVKCIAKSNPLFQEFRLWQFIQNLRIYQREKEIDGKLLTDIDITSECLKSEEDYVRLFDWLNDRETIEQEDLLKHLFNTKKSKNKENPYRWNYVEDKVYPCNETRATILKGFSKCGINASVLSPELEMALWHILYSVEDKKEIETALTHFAQKQGWNDDFAKVFSKAKPFKKDYGSYSEKAIKKLLSLMRMGKYWNQDNIDKNTLDRIDKIINGEYDEKISNRVRDNAINLKDISDFRGLPVWLACYIVYDRHSEAKDCTKWNSPEEIDSYLKKFKQHSLRNPIVEQVVTETLRTVRDIWIQEEQIDEIHLELGRDLKNPADKRKKMSENILKNENTNLRIKAMLMEFMNPSMGIENVRPYSPSQQDILRIYEENALDNLTKDDKDFDFISKISKQAQPSKTDIIRYKCWLEQKYRSPYTGKTISLSKLFTPAYEIEHVIPQSLYFDDSFSNKVICEAEVNKLKDRQLGYKFIAEHHGEKVQLSQGEVVEILSVDAYEKFVKENYANNRIKMKKLLMESIPDEFIERQLNDSRYISKVVKGLLSNIVREKIDDENYEPEAVSKNLISCNGAITDRLKKDWGMNDVWNSIILPRFIRMNQITGKDCFTTTNAEGHLIPQMPLELQKGFNKKRIDHRHHAMDAIVIACTTRDHVNLLNNEAAHSKFNATRYQLQRKLRRFEKAVIDGKEREVAKEFLKPWDSFSSDSKNILENIIVSFKQNQRVINKTTNAFLHFDENGKKTFIKQGKGDSWAIRKSMHKDTVFGEINLRKVRSVSLNEAIKVPERVLNKKIKEKILELKNNKIDAKNIKKYIEENHTGGYGIDSSKIDVFYFTKETKERFFATRKTLDTSFNQAKIKDSIADSGIQKILLAHLKSKNGDAEQAFSPDGIDEMNKNIVELNNGKFHQPILKVRVYEKADKFAVGQKGNKKVKFVEAAKGTNLFFAIFEKDGKRSYLTIPLNVMIDCQKQYGNQWKNNIEAYLKEKELVEKDVKLQFILSPNDLVYLPTEGSIDKKRIYKVVSFTNNRLYAIPYAIAKSIVDKNEFTQLNKIEFTDNKESIKDACVPVIIDRLGNVIEFNGKRL

SEQ ID NO: 1322 - protein, 1512 aa, Artificial Sequence
  Cas9
MKNILGLDLGTNSIGWAVINSEEDGPIVKKRIELAGSRIIPMDAAVLGNFDSGVTKSQTAERTSFRSIRRLRERQLLRRERLHKVLQILGFLPEHYVNDIDFENHPGKIKRNTEPKLPWRKNSMGQFEFIFQDSFEAMLTDFATHQPVFVSEGKKVPYDWTLYYLRKKALTEGISKEELAWLILNFNQKRGYYQLRGEEEEEQSNKLVEFYALRVVKVEATDDKKGKDTWYNVHLENGWIYRRTSNIPLDWEGKVKEFIVTTDLNEDGTPKLDKYGEVKRSFRAPKEDDWTLIKKKTESDIANSHKTVGCYIYDALLQNPHQKIKGRLVRTVERKFYKEELRLILEKQLSFHPELQDRDLYRACIDALYVSNEAHKNNISGRDFVYLFIDDIIFYQRPLKTKKSLIDNCPYEENQYMDRETGEVKQAPIKCIAKSHPLFQEFRLWQFISNIRIYQRERVLDDGKLETDVDVTPDFLKTEDDYTTLFEWFNDRKEVDQKAFLKNPQFGLKKTFTEYRWNYVEDKSYPCNETRNAILNGLQKAGVSADFLSREVEEALWHILYSVEDKIEIESALRKFASKHDLDDRFADVFKKLPPFKKEYGAYSAKAIKKLLPLMRIGKYWELSNIDDKTKERIDKIITGEWDENIHDRVREKAIKLSDITDFKGLPLWLSCYVVYNRHSEARAIAKWESPEDIDSYLRLFRQHSLRNPIVEQVITETLRTVRDIWKRVGQIDEIHVELGREIKNPADKRAKMTAQIVENENTNLRIKALLAEFINSEYEIENVRPYSSNQQEKLKIYEDTVLNGVKEIPEDINTILKKFRESDLKKRPTKSDFLHYKLWLEQKYCSPYTGRIIPLGKLFTSAYEIEHIIPQAHYFDDSFSNKVICEAEVNGLKDKKLGYEFIKHNPGKMVEIGFGKPPVRIFSVEEYERFVKENYSGIKNKMNKLLMDDIPETFIERQLNDSRYISKVVKSLLSNIVREKDSNGEYEPEAISKNVIVCTGSVTDRLKRDWGVNDVWNSIIYPRFERLNELTGSQQFGCWENKEGKRVFQTAVPLEMQKGFSKKRIDHRHHAMDAIVIACATRNHINYLSNESASKKAKISRTDLQRLLCTKCRTDDNGNYKWIVKKPWPAFTQDIRKALENITVSFKQNLRVINKTTNYYVHFDESGKKVLEKQINGDSWAIRKPMHKDTVFGKVNLQKVKEVRLSLALDTPKMIVDKKLKEKVLQLYSYKYDKKRIDKYFKENASLWKDLNLSKVAVYYFTNDSTEPLVAVRKPLDTSFNAKKIKESVTDTGIQKILLNHLSNNQDDPNLAFSPDGIDKMNKNLTALNDGKYHQPIYKVRVCEPQGNKFSVGTSGNKTSKYVEAAKGTNLFFAVYQTEDGKRSYETIPLNVVIEREKLGWTPVPENNNNGDKLLFWLSPNDLVYVPTADELNNGMRLDNMDKGRIYKMISCSGPQCFFIPQNVSNAIIPVIELGANNKAEKSWNNEMIKVVCVPIRVDRLGCITQINNQK

SEQ ID NO: 1323 - protein, 1516 aa, Artificial Sequence
  Cas9
MKNILGLDLGTNSIGWSVIQEKHNENNECQKLILGAGSRIIPMDAAVLGDFAKGNTISQTKDRTQYRGVRRLRERCLLRRERLFRVLDIMGFLPQHFSNALTRYGKFKDADEEPKIAWRKDDEGKMHFLFADSFNEMIEEFRSVQPELLKRGMKVPYDWTLYYLRKKAMREAVTPFELAWLILSFNQKRGYYQLRGEEEGEADNSKSEEYLAQRVVDVIDTGEKKGKSTWFDIVLENGMVYHRPAEIKPDWIGKTKEFIVTTQFDKDGNPKKDKEGNVKMSFRMPNENDWNLQKKKAEKDIDESGMTVGEYIYNALLHNPKQKIKGKLVRVVERKYYKNELQKILESQKRFIPQLSDSALYEKCIKELYQSNEAYRNSISTRNDFTYLFVDNIIFYQRPLKSKKSLIDNCPYESLAYTKDGEEHKAPVKCIAKSHPLYQEFRLWQFISNLRIYQRQKQVGDKVKLDVDVTDEFLPTDDRRESLFDYLNDKTEIKQDVLLKEFFSMKKPKGKDSVYPYRWNYVEDKSYPCNVTRGKILAKLNRAGISADFLSSNGNEESLWHILYSVEDKGELRKALARFAAKNGLDDAFTEALADIEPYKKEYGAYSAKALKKLLPLMRLGKYWNYDNIAPATKARISKIIDGEYDENIRNRVREKAMSLNSASQFQGLPLWLACYIVYDRHSERADSGRWSSPEDIDKYLSDFKQHSLRNPIVEQVVTETLRTVRDIWKRYGEISEIHVELGREMKNPADKRSKMNRRMLENENANMRAKLLLTEFMNPEFGIENVRSYSPSQQELLRIYEDGAISNAGSEIDDEISDIMSRLSQVDVKKQPTASEVKRYILWLEQNYRSPYTGQMIPLAKLFTPAYEIEHVIPQSRYFDDSFSNKVICEAEVNKLKDRMLGYEFIKQHKGEKVSLSMGGTVEILSPEEYVRHVESQYKNNKAKMRKLLMDDIPDEFINRQLNDSRYISKLIISLLSNIVREEGEEEATSKNVISCNGSITDRLKKDWGINDVWNHIILPRFRRLNELTGTDKFTTSNKEGHEVPEMPLELQKGFNKKRIDHRHHAMDAIVIACITRDHVNLLNNEAAMSKNNANRIQLSKKLRRYESVEIEKDGIRKQISMAKEFKKPWEGFTADVERTLRDIVVSFKQNLRVINKTTNYYQHFKDGKKIYSPQSKGDSWAIRKSMHKETVFGEINIRRIKEVSLKEAMKRIKDIADKELRSKIVELMALQYNEKKIKQYFSDNKDEWSDVNPKKIKIHYFTKETNERFFATRKPLDTSFDKKKIKTQVADTAIQKILLNHLSAHGDKAETAFSPDGIDEMNRNIIELNDGKFHQPILKVRIYEKADKYAVGQQGNKKKKYVEAAKGTNLFFAIYAEEKIDEKTGDTVITRTYDSIPLNVVIDREKRGLSPVPENENGAKPKYVLSPNDLVYVPNEEERETGRICEPLDKERIYKMVSSNKKQAFFIKSEVASTIVDKFEFSALNKQERALSGEMIKEICIPISINRIGEITLR

SEQ ID NO: 1324 - protein, 1517 aa, Artificial Sequence
  Cas9
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICPFIKVDRLGNIIQVGSCILTN

SEQ ID NO: 1325 - protein, 1520 aa, Artificial Sequence
  Cas9
MKKIVGLDLGTNSIGWALINAYIDEYNKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKIPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPHAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICPFIKVDRLGNIIQVGSCILTN

SEQ ID NO: 1326 - protein, 1520 aa, Artificial Sequence
  Cas9
MKKIVGLDLGTNSIGWALINAYIDEYNKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGEKKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIITRLGKAHIPKAFLSKEKEETLWHILYSIEDKQEIEKALHSFANKNNLSEEFIEQFKNFPPFKKEYGSYSAKAIKKLLPLMRMGKYWSIKNIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKSPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSLNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICPFIKVDRLGNIIQVGSCILTN

SEQ ID NO: 1327 - protein, 1524 aa, Artificial Sequence
  Cas9
MNKILGLDLGTNSIGWAIVQKDEQGFYEKIINAGSRIIPMDAETMNNFNKGITKSPASERTRFRGARRLIERSLLRRERIHRLLNTMNYLPPHYAEKIDFVNRLGKFIGEEEPKYAYKVDEHGKFQFIFKESFNEMLKDFQDKQPELVLNNKKVPYDWTIYYLRKKALNRAISKEELGWIILQFNNKRGYYQLRGEEDETLTEGQKKEYFALKVIRVEADSSSAGKKGEVWYNVQLENGWIYRCKSEIPLDWEGKIKEFIVTTEVDENDNVLKDKEGKEKRKLKIPEAGDWTLLKKKTESDLDKSGKTVGAYIYDTLLSNPDQKIKGGLIRTIERELYRSELEQILDKQKEFHPELKDGTLYNKCVEELYRSNESRRISLSNYDFTRFITEDVIFYQRPLKSKKSLIDNCSFERRNYLNPITKELAYAPIKCIAKSHPLFQEFRLWQFIKNLRIIEREKIVGDKLMFDQDVTTEFLPTQNDYVILFDWLNEHKEIDQKALLKYPAFNLKKNIDKYRWNYVENKSYPCNETRALLKAKLNKAGNIPSDFLDNDTLESLWHILYSVEDKFEIEKALKSFATKKELREEQTVAFVKQFINIPPFKKEYGSYSAKAIKKLLQLMRMGSRWSENEISDSTKDRIQKLIDGEWDESIKTRTRDKAIKLNEINDFQGLPLWLASYIVYDRHSESGDVMKWETPEDIDYYLKHVFKQHGLRNPIVEVVVVETLKVVKDLWKTYGYFNEIHIELGREMKNPADKRRSMTNKNIENENTNLRIKALLAELANHKDVEGVRPYSPSQQEILKIYEEGVLDMLTKEDPDYESISKISKMALPSSSELIRYKCWLEQKYRSPYTGQVIPLARLFTSEYEIEHIIPQSRYFDDSFSNKVICESAVNKDKDNLLAYEYIKQNEGKIIEIGLGKKVKLFTADSYTEFVQSNYVGSVAKKKKLLMDTIPDSFIKRQLNDSRYISREIMKLLSSVVREKEEEEEEEEEEAISKNVIVCTGAITDKLKREWGLNDVWNTIIYPRFERLNQLTNSDKFGQWENKQGKKVFQIEMPLKLQKGFNKKRIDHRHHAMDAIVIACATQSHVNYLNNESAHSNSKEKRYYLRRKLRRIEILEKQELKDGVTITKKIEVAKEFNKPWPTFTQDAHEVLQSIIVSFKQNLRVVNKATNRYACFVNGKKEIVKQSKGESWAIRKPMHKDTVSAAVSLRKIKTVSLSQAIDDWTNIVDKSLRKEIGLLYSKYGQNGSKNIIKYFKDRDNKHNGLDVSKVNVHYFDNDYAASRVALDHKFNSAKIKSITDTGIQTILLKHLESYNEINGDKIIEHPELAFSADGLDILNANITKLNNGKFHKPIKKVRKTETLGLKFIVGQTGNKRKKYVEAADGTNLFFAIYVSVDGIRSYKTIPLREVAERLKEGLIPVPEKNDKDDHLLFWLSPGDLVYVPSIEEEGRIVEIENIKQDRIYKVVSCTENECHCIPHFVASPIVKTDELGANNKAQRAWSGEMIKETCIKIKMNRLGQIVKI

SEQ ID NO: 1328 - protein, 1526 aa, Artificial Sequence
  Cas9
MKKILGLDLGTNSIGWAVLNAADDNSLKYIEAAGSRIIPMDAAILGDFDRGNSISQTAERTRIRGMRHLRERYLLRRARLHRILNLLGFLPFHYAQDIDRYGNFSADMEPKIAWRKNLEGELEFIFIESFNEMLEDFRKNQPELVADNKKVPYDWVIYYLRKKALEKKISKEELAWILLNFNQKRGYYQLRGEDDDESMKTAKTRQYFDKQIIKNIIDTNQTYKGQRILIVELQNGDKGKIFKKEIPDWIGQEKNIIVTVDIDKDGNDKYEESGSLSCRFKIPTDAEWESEWKLIKMKTQKDLDESNKTVGTYIYDSILQNPTQKVRGKLVRTIERKYYKAELKQILEKQTEFHSELQDKDLYIECLNELYSNNDTHRNAITDRDFVYLFMNDILFYQRPLKSKKSLIDNCPYERNIYIDKETGEIKYSPIKCIAKSHPLFQEFRLWKFISSIRIYQRESVVEVVDKQLDLFSSQSTSVQKLVTDVDVTDKFLTCENDYVALFEWLNKKKIIDQKEFLKYRPFGLKGDIDNYRWNYVEDKSYPCNETHAMILTYFAKAGISEDILTKEMEEALWHILYSVEDRQEITKALRTFASKYHLSDSFVKVFSNIPPFKKEYGSYSAKAIKKLLSLMRMGKYWSEDAIDVNTRERIDKIVTGEYDEKIRDRVREKTIRLNDIRHFRALPDWLACYVVYDRHSETREITEWKSPEEIDEYIRNFKQHSLRNPIVEQVITETLRTVRDIWKQVGCIDEIHVELGREMKNPADKRKRITSQIIENENANLRVKALLTEFVNPEFEIENVRPYSLGQQDILRIYEDGVLNSVAEVPGDIAGILKKFNENDAKKRPTTSEILRYKLWLEQKYRSPYTGEMIPLSKLFTSAYEIEHVIPQSRYFDDSFSNKVICEAEVNKLKDNALGYEFIKKHHGEKVELGFGKIVEIFSVSVYEQFVKDNYSRNRGKMKKLLMDEIPEQFIERQLNDSRYISKVVKTLLSNVVREKAEQEAVSKNVIVCTGGVTDRLKKDWGINDVWNKIVLPRFLRLNELTNSTNFTAKNAAGNEIPAMPLELQKGFNKKRIDHRHHAMDAIVIACANRNIVNYLNNESASRKAKISRHDLQAILCDKVRTDDKGNYQWRVKKPWDTFTQDVYVALENIIVSFKQNLRVINKTSNYYWHYENGKKVLVKQVKGDSWAIRKPMHKDTVFGEVNLRKVKSVSLNEALKNPQFIVEKDLKRQLLSLLQQNFDIKKIKKYFEEHKDIWSDISLSKMNIYYFTKETKDRYFATRKPLDASFDKKKIESCITDTGIQQILLRHLELKENDPERAFSPDGIDEMNRNIIQLNKGKGHHPIAKVRVYEKADKFEVGQRGNKSSKFVEAAKGTNLFFAVYETEYPDEKTNSIVRKRNYATIPLNIAIERQKRGLSTAPEDEKGNVPSFVLSPNDLVYLPTSEDIVNGHITQPIDKSRIYKMVSSSGSQCFFIKHNIANIIVDKYEFSPLNKMERAISNEMIKEICIPVKVDRLGNIVKLGKSE

SEQ ID NO: 1329 - protein, 1526 aa, Artificial Sequence
  Cas9
MKKILGLDLGTNSIGWAVLNAADDNSLKYIEAAGSRIIPMDAAILGDFDRGNSISQTAERTRIRGMRHLRERYLLRRARLHRILNLLGFLPFHYAQDIDRYGNFSADMEPKIAWCKNLEGELEFIFIESFNEMLEDFRKNQPELVADNKKVPYDWVIYYLRKKALEKKISKEELAWILLNFNQKRGYYQLRGEDDDESMKTAKTRQYFDKQIIKNIIDTNQTYKGQRILIVELQNGDKGKIFKKEIPDWIGQEKNIIVTVDIDKDGNDKYEESGSLSCRFKIPTDAEWESEWKLIKMKTQKDLDESNKTVGTYIYDSILQNPTQKVRGKLVRTIERKYYKAELKQILEKQTEFHSELQDKDLYIECLNELYSNNDTHRNAITDRDFVYLFMNDILFYQRPLKSKKSLIDNCPYERNIYIDKETGEIKYLPIKCIAKSHPLFQEFRLWKFISSIRIYQRESVVEVVDKQLDLFSSQSTSVQKLVTDVDVTDKFLTCENDYVALFEWLNKKKIIDQKEFLKYRPFGLKGDIDNYRWNYVEDKSYPCNETHAMILTYFAKAGISEDILTKEMEEALWHILYSVEDRQEITKALRTFASKYHLSDSFVKVFSNIPPFKKEYGSYSAKAIKKLLSLMRMGKYWSEDAIDVNTRERIDKIVTGEYDEKIRDRVREKTIRLNDIRHFRALPDWLACYVVYDRHSETREITEWKSPEEIDEYIRNFKQHSLRNPIVEQVITETLRTVRDIWKQVGCIDEIHVELGREMKNPADKRKRITSQIIENENANLRVKALLTEFVNPEFEIENVRPYSLSQQDILRIYEDGVLNSVAEVPGDIAGILKKFNENDAKKRPTTSEILRYKLWLEQKYRSPYTGEMIPLSKLFTSAYEIEHVIPQSRYFDDSFSNKVICEAEVNKLKDNALGYEFIKKHHGEKVELGFGKIVEIFSVSVYEQFVKDNYSRNRGKMKKLLMDEIPEQFIERQLNDSRYISKVVKTLLSNVVREKAEQEAVSKNVIVCTGGVTDRLKKDWGINDVWNKIVLPRFLRLNELTNSTNFTAKNAAGNEIPAMPLELQKGFNKKRIDHRHHAMDAIVIACANRNIVNYLNNESASRKAKISRHDLQAILCDKVRTDDKGNYQWRVKKPWDTFTQDVYVALENIIVSFKQNLRVINKTSNYYWHYENGKKVLVKQVKGDSWAIRKPMHKDTVFGEVNLRKVKSVSLNEALKNPQFIVEKDLKRQLLSLLQQNFDIKKIKKYFEEHKDIWSDISLSKMNIYYFTKETKDRYFATRKPLDASFDKKKIESCITDTGIQQILLRHLELKENDPERAFSPDGIDEMNRNIIQLNKGKGHHPIAKVRVYEKADKFEVGQRGNKSSKFVEAAKGTNLFFAVYETEYPDEKTNSIVRKRNYATIPLNIAIERQKRGLSTAPEDEKGNVPSFVLSPNDLVYLPTSEDIVNGHITQPIDKSRIYKMVSSSGSQCFFIKHNIANIIVDKYEFSPLNKMERAISNEMIKEICIPVKVDRLGNIVKLGKSE

SEQ ID NO: 1330 - protein, 1527 aa, Artificial Sequence
  Cas9
MAKILGLDLGTNSIGWAIVEKDGNDFSLVDKGVRIFSEGVKSEKGIESSRAAERTGYRSARKIKYRRKLRKYETLKVLSLNGMCPLSIEEVEEWKKSGFKEYPLNPEFLEWLRTSDDENINPYFFRDKASKQKVTLFEVGRAFYHIAQRRGFLSNRLDQSAEGILEEHCPKIEALVEDLNSTDEILTSLKDYFFDTGILDANEKGGFAKDLDEGDKKLVSLYRSIQAIVKKNDTDFEKGKAEIIERLNKKDVLGKVKGKIKDISQAMLEGNFKTLGQYFFSLYNKERIRNQYTSREDHYLEEFKIICKFQGIGSINQNEKLPEKKFEGLAKELYKAIFFQRPLKSQKGLIGKCSFEKSKSRCAISHPDFEEKRMWEYLNTIKIGTQSEKVLRFLSQEEKLNLIPKFLRKKDNFNFEDLAKELIEKGATFGFYKSSKRDSFHYWFNYKPTDTVSGCPVSASLKSVVGEDWKTKSFIYKTTNSKGIEVSRTVNYKDLWHLLSVSTSDIYLYEYAKNKLGLEDKNAKAFSKIKLKKDFGNLSLNAINKILPYMREGLLYSHAVFMANIESIVDEVIWNDLGQRKYIQDKIAAIIANNIVDNGLLEVVNGLIKECKVDGAYYSKEAADTYRKDLSKKLVSFFKFHHIDDGIKQETILNELFPVFIEQLKAHEFIKVKRLDEKVLEFLKGENQDGEVFCNNAKQLKKLYHPSDIEVFKKQIVKDKDGTETGQLILGSPLTSSIKNPMAMRALHQLRKVLNTLIVEEQVDSSTRIHIEMARELNDANKRKGIQDYQNENKKEREKYRDEIKKLYLAECNKEIEPTVDDLLRYQLWIEQDRKEIYENGNSISICDIIGDNPAYDIEHTVPRSISQDNSQMNKTLCSQKFNRDVKKQKMPFELGNHLEILPRIAHWKEEADNLSREIEMIIRSTKTAATKEAKDKKIRRRHYLTLRRDYLQGKYDRFIWTEPKVGFKNSQIPDTGIITRYAQAYLKSYFNRVESVKGGMVAEFRKIWGIQESYQENGKKYFKEKDRSKHTHHTIDAITIACMTKDKYDVLAHAWTLEDKEQITEARKIVAESKPWKTFKEDLKKIEEGILVSHYTPDNVKKQSKKIVRVRGRKQYVAEIERDVNGKAVAKKDISGKVIYKLDKDGKKLPRLQQGDTIRGSLHQDSIYGAIKNPLKTEEIRYVIRKDLESIKASDVDNIVDEMVKEKVKEAIASKVLILSSNPQQKNKIDGKVWMNEEKGIPINKVRLYANSVKNPLEIKEHSSLSKSRHEHKQKVYGQNDENFAMAIYEGLDKKGKTERAFELINYMDAGYYYKLKNKNERKKDIISLVPEKHIETGFNLLRSNKIPIILKKGLNVILYKNEKEEIDFNNPNSIIKRLYKISGLDKDGIKLMYCISAKGSTENIAYMNDVINKQKLFELKSEMEKLGLWDKVFSDFKNDNLKKSDFFKKLNDLLNKHYFENNVCDSIGSIKKVKIKESGLTTPKGGDVIDNFKDFPYIKFKVSNFNALIEGIDFKISPTGKFVQI

SEQ ID NO: 1331 - protein, 1528 aa, Artificial Sequence
  Cas9
MKKILGLDLGTNSIGWALVEQDFKNKQGNIMGMGSRVIPMSQEILGEFARGNTKSETAERTRLRSVRRLRERHLLRRERLHRVLHILGFLPKHYVNQIDFQERLGKFFEESEPKLAYDTGDFLFKPSFLEMLEEFKIHQPSFVEGDKKVPYDWTIYFLRKKALTERIEKEELAWVILSFNQKRGYYQLRGEDEEEKPNKLEEFYSLKIVDIKVDESPNKKGDTWYSLTLENGWIYRRSSKVPLDDWLGKTRDFIVTTDIDEEGNPKLDKEGNPKRSFRAPSEDDWGLRKKKTEKEILDSSKTVGHFIFENLLADPTQKIKGRLVRTIERKFYKDELKQILVSQNRFHPELSDADMMADCVRELYKHNHSHQNFLASKDIKHLLVDDIIFYQRPLRSQKSTIGNCPLEFKTFKKDGIEIKVPYKVAPKSHPLFQEFRLLQWVSSLRIIRKSDDSDVTREFLGTQDKTKQLLDYLMTQSEMDCNKLMTFLLTQEGYKRKDLKSEVGKFRWNYVFDSETGESKTYPGNSTRAEFLKRLGKVEGFDFSKYTEEFEESLWHLVYSVTDKVEFEKALRKFSRKNGIEINSFVENLKKFPPYKSEYASYSLKAIKKLLALMRFGENWKEDSIDSISKHRIEKILTGEYDPEIKDKVREISRAFDEVEDFQGLPVWFANYVVYGRHSEASELIKWTSSDEMADFIKEFKQHSLRNPIVEQVVLETLRVVKDIWDKYGHGQKDFFDEIHVELGRELKNPAEQRARLTTQISANENTNLRIKSLLVELLHDPGVENVRPYSPMQQEILKIYEEGVLKSSFEVPDDILKISKTAQPSSSDLKRYKLWLEQKYRSPYTGKIIPLNKLFTPAYEVEHVIPQSRYFDDSFSNKVICEAAVNKLKDNRLGMEFIKCFHGQRVSLGFGEEVEIFSESAYKAFIQDNFPKNPAKKRKLLMDELPEQMVERQMNDTRYISKFVTSILSNIVRSEENDTGFNSKNIIPGNGKITTALKQDWGLNDVWNELILPRFERMNQLTGTTVFTAWNENHQKFLPTVPLEYAKGFQKKRIDHRHHAMDALVIACATRDHVNYLNNEHALGKNYKGKEEKQSRRFDLRQKLCLKKKNGHSQEQYEWIFSKPWDSFTQDAKKNLERIIVSFKQNLRVINKTSNKYLSYKDEEGNLRLDSQGKPVKALTRQIKGDAWAIRKSIHKDTVSGLVKLRRVKMVNLSVALDNPENILNKKLKKKIAELVKLNYDNKLLLKYFRDRDYMFDGREVSKLDVYYFEEGLAASRVSLDTSFSDKKIQSITDTGIRKILLAHLANYHGRLDEKGKVIPPETLAFTPEGIEELNKNIKGLNGGKFHQPIFKVRTYEPKGNKFQVGFKGNKNSKYVEAAKGTNLFFAIYLNDEGKRSYETIPFNVVMERLKQGEGPVPQTNEKGGKLLFHLSPNELVYVPETDENYTNVDFKNLSKEQVEKIYKMVSSTGSECHFVRADISSLIKGYDAKTKVGELGSLNKQEVTNNGMTRIKEKCWKIKIDRLGSI

SEQ ID NO: 1332 - protein, 1528 aa, Artificial Sequence
  Cas9
MKKILGIDLGTNSIGWAVVNSFDENQNEESLKHIECVGSRIIPMDAAILGDFDKGNSISQTAKRTEFRSVRHLRERHLLRRARLHKILSLLGFLPDHYVQDLDSHGNFPVNVEPKIAWRKDSNGAFEFIFNDSFDEMLQDFATYQPELIACNKKVPYDWTIYYLRKKALTKKLSKEELSWILLNFNQKRGYYQLRGEEDDESVKSAKTRQYFDRQKIKSIVDTNQTYKGQKVLIVELEDGIKGKIFKKEIPNWVGQEKSIIVTIDIDKDGCDKYEESGELSCRFKIPSDAEWESEWKLIKMKTQKDLDASGKTVGAYIYDAILQNPSQKIRGKLVRTIERKYYKEELKQILKKQVEFHPELRDKDLFLDCLNELYPNNDAHRNACADRDFIYLFMDDILFYQRPLKSKKSLIADCPYEKHMYRDKETGELKYSSVKCIAKSHPLFQEFRLWHFISNIRIYQKERVVDVDADQSALSSARSALKSKLEADVDVTNEFLTCEADYVSLFEWLNNKKSVSQKDFLKYPAFGIKKSGDNYRWNYVEDKSYPCNETRALILSHLEKANIRGDIFTREQEEALWHILYSVEDRYEIVKALQSFAAKYRFNDDFVTVFSKFPPFKKEYGSYSAKAIKKLLPLMRMGKYWSEAAIDIKTRERIEKIITGECDDSIRERVRLKAIRLHDIGDFRALPVWLACYVVYDRHSESGDITKWKTPQEMDWYIQNFKQHSLRNPIVEQVITETLRVVRDIWKQVGRIDEIHVELGREMKNPADKRAKMTARMIENENTNLRIKAMLTEFLNPEFEIENVRPYSASQQDILRIYENGVLNSVSEIPEEITGILKKFNEREQRKRPSTSEVLRYKLWLEQKYRSPYTGKMIPLGKLFTPAYEIEHIIPQSRYFDDSFNNKVICEAEVNKLKGNLLGYEFIKKHHGRRVDLGLGEIVDIFSVDEYETFVKDYYSANQQKMKKLLMDEIPEQFIERQLNDSRYISKVVKSLLSNIVREQDEQESISKNLIVCTGGVTDRLKKDWGINDVWNKLILPRFQRLNNITETTEFTAKNMQGHEIPVVPFEYQRGFNKKRIDHRHHAMDAIVIACAGRNIVNYLNNESARKKAQISRYDLQRLLCDKVKTDDNGNYKWILKKPWSTLTQDVYAALDNVIVSFKQNLRVINKTNNHYVHYEAGKKIIAKQEKASWAIRKPMHKDTVFGEVNLRKVKTVSLNEAIKSPHCIVQKDFKKKLLSLLKQNFDAKEVKAYFEEHKDVWSDINLSKIEVYYFTKDTKERFFATRKPLDSSFDRKKIESVTDTGIQKILLRHLEQKNGDSDLAFSPDGIEEMNQNIVQLNGGRKHQPIVKVRVYEKADKFAIGQQGNKASKYVEAAKGTNLFFAVYEEEVRDKKTNAVMFKRNYASIPLNVAIDRQKKGLSTAPEDENGNAPIFVLSPNDLVYLPTAEDIINARISFPINKNRIYKMVSCTGYQCFFIKHHVANVIVDKKEFSALNKMEKAETNEMIKDICVPIKLDRLGNIVKIGVYK

SEQ ID NO: 1333 - protein, 1528 aa, Artificial Sequence
  Cas9
MKKILGLDLGTNSIGWAVVNSFDENQNEESLKHIECVGSRIIPMDAAILGDFDKGNSISQTAKRTEFRSVRHLRERHLLRRARLHKILSLLGFLPDHYVQDLDSHGNFPVNVEPKIAWRKDSNGAFEFIFNDSFDEMLQDFATYQPELIACNKKVPYDWTIYYLRKKALTKKLSKEELSWILLNFNQKRGYYQLRGEEDDESVKSAKTRQYFDRQKIKSIVDTNQTYKGQKVLIVELEDGIKGKIFKKEIPNWVGQEKSIIVTIDIDKDGCDKYEESGELSCRFKIPSDAEWESEWKLIKMKTQKDLDASGKTVGAYIYDAILQNPSQKIRGKLVRTIERKYYKEELKQILKKQVEFHPELRDKDLFLDCLNELYPNNDAHRNACADRDFIYLFMDDILFYQRPLKSKKSLIADCPYEKHMYRDKETGELKYSSVKCIAKSHPLFQEFRLWHFISNIRIYQKERVVDVDACQPDLSSARSALKSKLEADVDVTNEFLTCEADYVSLFEWLNNKKSVSQKDFLKYPAFGIKKSGDNYRWNYVEDKSYPCNETRALILSHLEKANIRGDIFTREQEEALWHILYSVEDRYEIVKALQSFAAKYRFNDDFVTVFSKFPPFKKEYGSYSAKAIKKLLPLMRMGKYWSEAAIDIKTRERIEKIITGECDDSIRERVRLKAIRLHDIGDFRALPVWLACYVVYDRHSESGDITKWKTPQEMDWYIQNFKQHSLRNPIVEQVITETLRVVRDIWKQVGRIDEIHVELGREMKNPADKRAKMTARMIENENTNLRIKAMLTEFLNPEFKIENVRPYSASQQDILRIYENGVLNSVSEIPEEITGILKKFNEREQRKRPSTSEVLRYKLWLEQKYRSPYTGKMIPLGKLFTPAYEIEHIIPQSRYFDDSFNNKVICEAEVNKLKGNLLGYEFIKKHHGRRVDLGLGEIVDIFSVDEYETFVKDYYSANQQKMKKLLMDEIPEQFIERQLNDSRYISKVVKSLLSNIVREQDEQESISKNLIVCTGGVTDRLKKDWGINDVWNKLILPRFQRLNNITETTEFTAKNMQGHEIPVVPFEYQRGFNKKRIDHRHHAMDAIVIACAGRNIVNYLNNESARKKAQISRYDLQRLLCDKVKTDDNGNYKWILKKPWSTLTQDVYAALDNVIVSFKQNLRVINKTNNHYVHYEAGKKIIAKQEKASWAIRKPMHKDTVFGEVNLRKVKTVSLNEAIKSPHCIVQKDFKKKLLSLLKQNFDAKEVKAYFEEHKDVWSDINLSKIEVYYFTKDTKERFFATRKPLDSSFDRKKIESVTDTGIQKILLRHLEQKNGDSDLAFSPDGIEEMNQNIVQLNGGRKHQPIVKVRVYEKADKFAIGQQGNKASKYVEAAKGTNLFFAVYEEEVRDKKTNAVMFKRNYASIPLNVAIDRQKKGLSTAPEDENGNAPIFVLSPNDLVYLPTAEDIINARISFPINKNRIYKMVSCTGYQCFFIKHHVANVIVDKKEFSALNKMEKAETNEMIKDICVPIKLDRLGNIVKIGVYK

SEQ ID NO: 1334 - protein, 1529 aa, Artificial Sequence
  Cas9
MKKILGLDLGTNSIGWAVVNSFDENQNEESLKHIECLGSRIIPMDAAILGDFDKGNSISQTAKRTEFRGVRHLRERHLLRRARLHKILRLLGFLPDHYVQDLDGHGNFLVNVEPKIAWRKDSNGTFEFIFNDSFDEMLQDFATYQPELIACNRKVPYDWTIYYLRKKALTKKLSKEELSWILLNFNQKRGYYQLRGEEDDESVKTAKTRQYFDRQKIKSIVDTNQTYKGQKVLIVELEDGVKGKIFKKEIPNWVGQEKSIIVTVDIDKDGCDKYEESGELSCRFKIPSDAEWESEWKLIKMKTQKDLDASGKTVGAYIYDAILQNPSQKIRGKLVRTIERKYYKEELKQILKKQVEFHPELRDKDLFLDCLNELYPNNDAHRNACADRDFIYLFMDDILFYQRPLKSKKSLIADCPYEKHMYRDKETGELKYSSVKCIAKSHPLFQEFRLWHFISNIRIYQKERVIDVDACQPDLSSARSALKSKLEADVDVTNEFLTCEADYVSLFEWLNNKKSVSQKDFLKYPAFGIKKSGDNYRWNYVEDKSYPCNETRALILSHLEKANIRGDIFTREQEEALWHILYSVEDRYEIVKALQSFAAKYRFNDDFVTVFSKFPPFKKEYGSYSAKAIKKLLPLMRMGKYWSESAIDIKTRERIEKIITGECDDSIRERVRLKAIRLHDIEHFRALPVWLACYVVYDRHSESGDIMKWKTPQEMDSYIQNFKQHSLRNPIVEQVITETLRVVRDIWKQVGRIDEIHVELGREMKNPADKRKEMTKRIIENENTNLRIKAMLTEFLNPEFEIENVRPYSASQQDILRIYENGVLNSVSEIPEEITGILKKFNEREQRKRPSTSEVLRYKLWLEQKYCSPYTGKMIPLGKLFTPAYEIEHVIPQSRYFDDSFNNKVICEAEVNKLKGNLLGYEFIKKHHGQRVDLGLGEIVDIFSVDEYETFVKDYYSGNQQKMKKLLMDEIPEQFIERQLNDSRYISKVVKSLLSNIVREQDEQESISKNVIVCTGGVTDRLKKDWGINDVWNKLILPRFQRLNNITETTEFTAKNMEGHEIPVVPFEYQRGFNKKRIDHRHHAMDAIVIACASRNIVNYLNNESARKKARISRYDLQKLLCDKVRTDDNGNYKWILKKPWGTLTQDVYAALDNVIVSFKQNLRVINKTKNYYVHYEAGKKTIAKQEKGSSWAIRKPMHKDTVFGEVNLRKVKTVSLNEAIKNPQCIVEKDFKKKLLSLLKQNFDAKKVKAYFEEHKDVWSDINLSKIEVYYFTKDTKERFFATRKPLDSSFDKKEIESVTDTGIQKILLRHLEQKNGDPDLAFSPDGIEEMNHNIVQLNGGRKHQPIVKVRVYEKADKFAIGQQGNKSSKYVEAAKGTNLFFAVYEEEVRDKKTNAVMLKRHYASIPLNVAIDRQKKGLSTAPEDENGNVPIFVLSPNDLVYLPTAEDIANASISFPINKNRIYKMVSCTGNRCFFIKHHVANVIVDKSEFSVLNKIEKAETDEMIKEICVPIKIDRLGNIVKIGVYK

SEQ ID NO: 1335 - protein, 1535 aa, Artificial Sequence
  Cas9
MNTILGLDLGTNSIGWALIKVLNDKTRLPLEIIDLGVVVIPTDQRTLDKFSKGESISKTAERTKQKGVRKLYERKKLRRERLHRVLNILGFLPEHYSKKIDFKKHLGQFFGNSQPKISYVENDHGKHEFIFMDSYREMLKEFSKHNIKNVPYDWTIYYLRKKALSQKISKEELAWVILNFNKKRGYYQFRDDNADENKENKIEKYYALKVTNVKKEDAQNYTITLENGWIYKNKSKISLLDWVGSTKEFISTEKFDNKGNIIKKKNGEDDRTLKLVDSEKDWIAIKKSTEDRIENYGKTVGTYLYEHLLKDPNQKLNGELINIIDRKFYKNELKQILEKQKEFHPELLNEDLFQKSIIELYPKNSTRQKELKNKDLCYLLIDDVIYYQRDLKKKNSTINKCSFESREYYLNGEKQIQKINCIAKSKPLYQEFRTLQFIKNLKVYEIIDGLEKDITSKLLPDFETKEHFFEWLNDKEKIDQLQLLSYKCFDLHDNVKNDLIAKGIKRPTEKAIRTELLEKYRWNYSKDNDRNFLLNETRFKILKYLKKVDKKLTLTNEQIESLWLLLYSAKDERELKNGLQKFSEKNKLPKKFSDIFISFPPFKKEYGAYSEKALKKLLSLVRFGKYWSFNKIDNNIQNKIMNILNGEVDDSISDRVREKTILLQDKNDFQDLPLWLASYVAYNRFSEVSEIKYWDSPDKIEFLKQHSIGNPIVEKIINETLKLIKDIWVIHGKSCKNFFSEIHIELSREIKSSSKKRAQITNNNTKNQKLNNLIKSLLIEMASDTKYENVTPYSPSQQEILKIYDEGIYSKEENSEKIKEINKIRNNNKISKSDITKYKLWLEQGYISPYTGKIIPLTKLFTAKYQKEHIIPQTKFFDDSFNNKVICEAEVNKLKDNSLAMNFIKAKGGKAVKLSDGETVTILNQEEYKQLVRTSFKKNSIKLRNLLLEEIPDTFTKRQLNDTKYISKLVLSLLSNIVREKGELESTAKRIVSTNGQITSILRNDWGLNNIWNKLITPRFERLNNINKNKIYGNWENKKGKNVFQINYLNDNLSTLNTKRIDHRHHALDALIVACTTRNHINFLNNQYAKSRNQRHDLRAKLKRRETITTEGSKKQVFKDFIKPWESFTQDALKKLETTIVNFKVNKRIINKTINWYKKWEKQKDGTYKKIQKKQTKGDAWAIRKPLHIDTIYGIVCKKLPLKSALENYKNIIDENLKHKIKELKEVNKFDNNQIINFFKECNFIFEDNNIQKVEVYDFKDNRDKTILSSSRQLIDESFTPKKIGKVLDPTIRNILLKHLNSTKYNNKFDSDGNPIKPEKLAFSPEGLKDLNKNIKHLNNNKEHQPIKRVKLFETLGNKIKVGYTQQKNKKFAETATGTNLFLGIYSDNNKRDFKTIPLILAIQREKEGLNPCPDTDEKGNQLLFSLSPNELVFVPNNEERKNPNLVDFENLSKDQIDRIYKFVSCTGSEAYFVPSRTAKPIIENENGTNNKSQRIIEFNEKTSIKNEKNEPVLIKTICWKIEVNRLGKIIKVIK

SEQ ID NO: 1336 - protein, 1535 aa, Artificial Sequence
  Cas9
MTKILGLDLGTNSIGWAIRDTENEGINQILDKGARIFSEGVKSENGKEISRAAERTAYRSARKIKYRRKLRKYETLKVLSINGMCPLSVEEVEQWKKSGFKEYPLNPEFLDWLRTNEDKNINPYLFRDKASKQKVTLFELGRALYHIAQRRGFLSNRLDQSAEGVFEEHNPQIQNLIEDLDSSNTILNELKEYYINLGIIDETEKSGFKKDLDEGEKKLKSLYNSLVAITKKNANDIETCKQELIARLNKKEDLGKVKGKIKDISQAMLDRNFKTLGQYFFSLYNKERIRNQYTSREEHYLEEFIIICQTQGIEGINTNEKLPEKKFTGLAKDLYRAIFFQRPLKSQKGLIGKCSFEKNKSRCAVSHPDYEEFRMWSYLNTIKIGTQSEKTLRFLTLEEKLKLVPKFYRKSDFNFEVLAKELVEKGASFGYYKSSKKNEFFYWFNYKPTDSVSACVVSASLENAIGKDWKIKTFEYQTRNTEKNEVTKSVDYKDLWHLLSVATSDTYLYDFAIEKLKLEPKNAKAFSKTKLKKDFASLSLAAIAKILPYLKQGLLYSHAVFMANIENIVDADIWKDEEQQKFIQSKIVELVDNYIVEKSKLELINGLLKIYNTEDKEGRKVYYSKEAESLFEADLRKKLVPFYKANIIIEEHEQEIIFQDLFPILMDQLKKQEFIKIGRLDKQIEAFLEGENEEGQIFCNHTDKLKKLYHPSDIEVFKKKTIKDEWGNEKVVLGSPLTTSIKNPMAMRALHQLRKVLNTLIANDQIDEDTRIHIEMARELNDANKRKGIQDFQNENKKFREEAIKEIKKLYLEECHKDVNPTEDDILRYQLWLEQGKCEIYEEGNNISICDIIGSNPSYDIEHTIPRSISQDNSQMNKTLCSLKFNRSIKKQKMPVELSNYNDILPRIAHWKKEAEELTRQIETISRSIKSAATKVAKDKNIRKRHYLTLKRDYILGKYERFTWEEPKVGFKNSQIPDTGIITKYAQAYLKSYFKRVESVKGGAVAEFRKLWGIQESFIDENWWKHYKDKDRDKHTHHTIDAITIACMPKDKYDLLAHAWRLEDEQDKKAAKVLIEQAKPWKTFKEDIEKIETEILVSHFTPDNVKKQSKSIIKNRGKKVYVLKNELPVNFKNKIEGKDYFKLKFDSKILYKIPKKKEKQTDTFYEELPKNYLNGVEGKDYFKINTTGKTFYKIPIFNQGDTIRGSLHQETTYGAIKLPDIDIETKKPLHTDKGGFILKKDIKGNEIVFFVVRKEISKISENDVQNIVDNVVRKKIENAIANSLITFKIVKKKKVAVIKEGVTIWMREPNIEKGIEGIPIKKVRIITNSVKNPIEIKVHSPLSKSRHKHKQKVYGQNDENYAMALYELDGKREFELINNFNLAKLLKQSQSYYPLHKEKEIKGKKILVPIEKRNNKDVILKRGQQVVFYDKTVENPKDISEIIDFRERIYIIEGLTIQRQKDKKTSKVNEYGIIQLRHFKEARKSEEISKDNFKPDGEFKINENKPTRKMNHNQFTAFVEGIDFKVLPSGKFQKI

SEQ ID NO: 1337 - protein, 1537 aa, Artificial Sequence
  Cas9
MKKILGLDLGTNSIGWALTTNDFDTKKGTIEGLGSRIIPMSQDILGKFDSGVSLSQTAQRTEYRGKRRLVQRFLLRRERLHRVLHILELLPKQYSEAIDFDKKLGQFKPEREQKISFYKNESGKNQFIFTKSHQEMLTEFQTYYPTIKNIPYDWTIYYLRKKALTEKISKEELAWILLNFNQKRGYYQLRGEEKEENKNKKEEFHTLLVTDIIERDKGKSGTWYNVILENGWIYKRESKISLADWIGKTKSFIVTTEYNDDGSVKLTKDNEEKRSFRSPKEDDWGLIKIRTEKTINQSDKSVGAYIYDALLKNPNQKIKGELVRTIERKYYKDELREILKKQLEFHSDVLNDKILYKKCIDELYKNNDSHKNSIKDRGFDYLFLDDIIFYQRPLKSKTSLISDCSLEFRPIKNKNGVLVKDTDGKQIAKALKCIARSNPIFQEFRLLQFVKNLKIYKRGVVDDVEVTNDYLKSENDVEKLFNWLNDKAEINQKQFLVNFKLKEDKHRWNFVEDKGYPCNETRNQFLNAIAKIDVDKSFFNTKNTQDLWHILYSVTDKIEITKAITTFAKRHNLPNEFIINFSKIKPYKKEYGSFSEKAIKKLLPLMRFGSYWDAKNIDIKTLDRIDKIQTGEFDEKIRNRVREKAIDLHKIDDFKDLPLWLASYIVYDKHSEASDVSKWKTPADIEKFLKHEFKQHSLRNPIVEQVITETLRVVKDIWLQYGEGKENFFNEIHIELGREMKNDKATREKISKKVSENENTNLRIKAILTELKNDGVSDIRPYSPSQQEILKIYEEGVYNNESRKEKLEEVDKIRKNAKPTTSEIIKYKLWLEQGYASPYTGKLIPMSELFTTKYQIEHIIPQSRFFDDSLSNKVICESEVNELKSNMTALEFILTNENRIVTLTGGETVKIFTKEAYNQHIISYYSKNKNKQKRLLTEEIPEQFISRQLNDTKYISKIVKNLLSKIVREEDEQEVTSKHVVSLNGSITSRMKQDWGLNDVWNTIVSPRFERLNTLTNSNDFGQFELKKDAYGNEGKRVFQTTVPDAIAKGFTKKRIDHRHHALDALVIACVNRTHINYLNNLNAKDTDDKAVKHELRNKLCFKTKPDSNGNYKWEFHKPWEKFTKEAQDKLNTTIVSFKQNTRVINKTVNKYVSYKDENGNLNVDANGLPQKKVITQTKGDNWAIRKPLHAETVSGKVFLKRIKQSHITIANAIEQVELIVDKEVKKQLKAKIKLYPNNIAGLKKHLKAFPVMINDKAIDKIQIYETLEATATRKILDITFDEKKIQKITDTGIQKILLNHLKQEKYQNTVDENGKKLAPHEIAFSENGLEDLNKNITFLNDGKNHQPIKKVRIFEEGNKFPLGEVGNKINKFVETAKGTNLFFAVYENDDKKRNYKTIPFNEVIERQKQGLNAALEIDENGNRLLFTLSPNDLVYIPLEDEIGYLNGVYFKNLNKEQTVRIYKFVSCTGGEGHFVPNNYSKEIISNENGSNNKNERMLNFNNFNIIFDGKEKPVMIKSICWKLEVDRLGKVIKIIK

SEQ ID NO: 1338 - protein, 1538 aa, Artificial Sequence
  Cas9
MKHILGLDLGTNSIGWALVKSEQDCDDVERINGIEAAGSRIIPMDAAVLGDFAKGNTKSQTADRTAARGIRRMGERHKLRRERLNRVLDVMGFLPEHYSAALTRYGKFKDGEECKIAWRKDESGQWTFVFEDSFREMLADFVAHQPEWLAGGRKVPYDWTIYYLRKKALSKPLTKQELAWLLLNFNQKRGYYQLRGEDEHTDDKGKLVEYYALKVVGVEDTGDKKGKDTWFNIMLENGMVYRRPAAEAPDWIGKTKEFIVTTDLEKDGTPKKDKEGNIKRSFRMPKEDDWTLIKKKTENDIDRSGKTVGEYIYDALLADPTQKIRGKLVRTVERKYYKEELKKIINSQKRFIPELNDNELYGRCISELYQSNDAYRQSISSCDFTYLFVDNIIFYQRPLKSKKSLIDNCPYEEHSYTDSKTGEVKTAPVKCVAKSNPLFQEFRLWQFVQNIRIFERQKKIGDSVKTDVDVTGEFIKSADDVVSLFDFLNDRKDITQSVLLGTYFKIKKPKGKDSDYPYRWNYVEDKTYPCNETRALILKGLKDAGIDEGFLDKDKEYSLWHILYSVEDKQEITKAMEKFAAKNSLGGKFAEVFSSLPPFNKNYGSYSEKAIKKLLALMRTGKYWSADAIDKHTLERIDKIINGEYDESIRTRVREKAINLTDVSHFRGLPLWLACYIVYDRHSESKDITCWNCPADIDQYLDHFKQHSLRNPIVEQVVTETLRTVRDIWRQYGKIDEIHIEMGRDMKNPADVRAKMSKRMIDNENANLRIKAMLAEFADPDFGIAGVRPYSPSQQEMLRIYEEGALESVDEVPDEINEIISKFNQTDIKKRPTHGEIIKYKLWLEQKYQSPYTGRTISLSRLFTDDYQIEHVIPQSRYFDDSMSNKVICEAEVNQLKDRMLGYEFIKAHHGEKVLLSSGETVTILTAEEYERLVQLNFRKNPVKMKKLLMDDIPDKFIERQLNDSRYISKKIKSLLSNMVRDEGEQEDISKNVIACNGAITDRLKRDWGVNDVWNHIILPRFERLNAVTGSDRFTTTSTNGHTIPDMPLNLQKGFNKKRIDHRHHAMDAIVIACTTRSHVNLLNNEAAMSKNNAVRYQLSRKLRRYEDTMVTRNGETRTISVAREFLKPWPTFNADVEKALRGIVVSFKQNLRVINKTVNKYQKFVYNEEKHIKEKKAVRQEERNGRHLLAIRKPMHKDTVYGEVNLRRIKEVSLKDAVANPKAVVDKDLKKKLMAMIELGYDLKQITKYFEDNKDAWQDVNLKKIKVYYFTKDTGDRYFATRFGNDLVTLFSKITKADDAKKQIERITDTGIQKILKRHLEANGGDCQKAFSADGIDEMNRNITQLNGGRPHKPVYKVRIYEKADKFAIGTKGNKAAKFVEAAKGTNLFFAVYLKEYEDSTTGETIKKRVFDTIPLKTVIDRLKNGQTPAPEEKDGAKLLFVLSPNDLVYLPTEDVVKNGTINRPLDKRRIYKMVSCTGTECYYIPFIVASPIVDKVEFFSLNKIGRAITGEMIKEICIPIKVDRLGNITEVNNEKI

SEQ ID NO: 1339 - protein, 1540 aa, Artificial Sequence
  Cas9
MNKILGLDLGTNSIGWALVGTDEEGNPIRIYKSGSRIIPMSQDVLGNFDRGNSISQTAERTSYRGVRRLRERHLLRRERLHRVLHLMGFLPSHYEEAIGWDKGDNKTFAKFYSDTEPKLPWRKNAEREHEFLFNTPYNEMLVDFRKNQPQLFKIKKNGQESLIPYDWTIYYLRKKALSKPISKKELAWIILNFNQKRGYYQLRGEEEEENSNKLIEYHALTVVKVIADEPQKGKSDIWYNAELENGWVYRRSSKTPLFDWESKVKEFVVTTDLNADGSLKVDKEGGVKRSFRVPSEDDWMLVKKKTESDIEKSDKTVGCYIYDTILQNPSQKIRGKLVRTIERKFYKKELTEILNKQKEFHSELQNKELYQECIKELYPHNEAHYDSLLVKDYTDLFVNDIIFYQRPLKSKKSLISNCPYEYRVYRNDSGIVERVPIKCIAKSHPLYQEFRLWQFIHNLRIYERQREVNGKPETDVDITAEFIPTTEDRVKLFDWLNNKKEIKQDTLLQSYFKIKKKKGDDKFPYRWNYVEDKEYPCNETRALILSRLTKLNLSEDFLTKEMELALWHILYSVEDKEEIKKAFKSFAQKHNLDDSFVDQFIKFPPFKKDYGSYSAKAIKKLLPLMRIGKYWDEKAISGNTRSRILSINERLEDMRSSGKKIEDVSDDDIPKQVLKSFDKVNGVYSGLNTYQACYAVYGRHSEASEITKWKTPQDIDDYLNEFKQHSLRNPIVEQVITETLRVVRDIWKKYGDFSEIHIELGREMKNPADKRAKMTTQISENENTNLRMKSLLAELKNHNDVENVRPYSPSQQEILKIYEEGVLNSVSEIPEEIIKITKSSQPSQTELVRYKLWLEQKYRSPYTGEIIPLGKLFTSAYEIEHVIPQSRYFDDSLSNKVICESEVNKLKGNLLGYEFVKNHHGVKVELNFNKTVEIFSINEYEEFVKGNYGKNRGKMKKLLLEDIPKSFIERQLNDTRYISKVVKGLLSNIVREDGEQEATSKHVIPCTGGVTTILKQDWGLNDVWNKIVTPRFERMNELTNTSLFGQWENKEGKRIFRTEVPLELQKGFNKKRIDHRHHAMDAIVIACATRSHVTYLNNESSKANAKEIRDGLKHKLCFKSKTDETGNYKWQFHKPWDTFTQDVQDTLENIVISFKQNLRVINKTTNRYQKYEEEKKILKSQEKGDSWAIRKPLHKDTVFAKVSLQKIKCVKLAMALKDWKNIVDKQLKKEIRRLILSYGKFDAEILNKYFKDRKYIFKDVDISKVDVYYFETEYVATRKNLDTSFDRKSIESITDTGIQKILLNHLGVKNNNPELAFSAEGIDEMNQRIVELNGGKQHQPIYKVRMYEPLGNKFQVGRIGNKKDKYVEAAPGTNLFYAIYQSEDKKRIYDTIPLNIIIERQKKELFPVPENKEDKDNLYKLLFWLSPNDMVYLPTEKEWANPDLFNFNNMTKNQRKKLYKFIDGSGTTANFIPNTVANIIFSIPKKDSGKYSMGNRIVQNEFGIGSPQSKNQKAFTGEMIKERCWKLKINRLGDIIECIK

SEQ ID NO: 1340 - protein, 1542 aa, Artificial Sequence
  Cas9
MEKRILGLDLGTNSIGWALVKGERHENDNETILSYIEAAGSRILPLDAAAQGDFEKGNPAKTQTSERTRMRGMRHLLERSLLRRERLHRVLDIMDFLPPHYSQSLTRYGKFKADTECKLAWRKTETGHYEFLFQDSFQEMLQDFQNHGKLEENKKIPYDWTIYYLRKKALTQPVSKQELAWILLNFNQKRGYYQREDQAVDDNQKKRVEYQALKVISVEDTGEKKGKNTWYDVRLENGLVYHYSAPIKPDWKGETKEFIVTTTIDQNGKPELDKDGKPKYSMRAPKEDDYKLLMEKTKKDITDSGKSVGEYIYDALLVNPQQKIRGGLVRTIERYFYKKELEKILLSQERFIPELTDRELYRRCVEELYPSNDAYRHLIESRDMRYLLVEDILFYQRPLKSKKSLIDDCPYESRSYVDRETGEIKSSPVKCIAQSHPLFQEFRLWQFIHNLRIYQNERSVEGKLQLDVDVTEEVLPTPESKAALFRFLNDRENVTQEILLKEVFKGRKLSVKDCPYRWNYAGEGKKYPCNETRHLMLKLLKKAGIDTAFLTPEKEQALWHIMYSVEDKDQYEKALSTFARKNDLPDGFKEQFKKAPTFKKDYGAYSLRAIKKLLPLMRVGEYWSADCIDSETKERISQIIRGEMDEKVSQRMTKSRDSFTDISQFQGLPVWQACYVVYGRHSEATEIQRWEKPEDIDVYLKAFKQHSLRNPIVEQVVLETLRVVRDIWKTYGKVDEIHIEMGRDMKNTAEERKRIFNRNQQNENDNLRIKALLTEFMNPDFEIEGVRPYSPSQQEALRIYEDGAWSGLDEEKEDKKELEAIREILGKFSQSDKAKRPTHSEVLRYKAWLEQRYSSPYTGEAIPLAKLFTPAYEIEHVIPQSRFFDDSFSNKVVCEAEVNKLKDRMLGYEFIKAHQGEVVSLSGTGRCARILSPEEYEQRVTDCYKHNTAKMKKLLMEEIPDDFIQRQMNDSRYISKLVKSLLSNMVREEGEREAISKHVITCNGTITDRLKKDWGVNDVWNHIILPRFQRMKDLTGRNDFVAVNSQGHEIPSVPPELQKGFKKKRIDHRHHAMDAIVIACTTRNHVNLLNNEAAMSENKANRIALSRKLRRYENCAIYKGGETKNISVAKEFLKPWATFPADVERALGDIVVSFKQNLRVINKATNHYEHYKDGKKVKVPQKKGDMWVVRKPLHKDTVYALVNLRNVKTVGLKDAILMPDRIANKDLKKKVKELLAQGDDLKKIKKYFETEKDTWQDVDVKKIEVYYFSEETANHYYATRKPFDANVKIDSVTDTGIQKILRRHLEENGNKADVAFSPEGIARMNENIFRLNGNKHHQPIYKVRVYEKANKYPVGQTGNKASKFVEAAKGTNLYLAVYESEVVDKKTAEISKKRSYVIVPLRDAVARQKQGVPVAPERNEEGGKLLFVLSPKDFVYVPTEEERSKGEVLLPLDKNRIYIMMDASDGIVNFLPYSVANLIYALPKDQASGFCTDGRMIQNEFGLGSPKSKNERALTGEMIKEICLPVKVDRLGRITEINGNKV

SEQ ID NO: 1341 - protein, 1547 aa, Artificial Sequence
  Cas9
MKKILGLDLGTNSIGWALTNNDFDNKLGSIEGLGSRIIPMSQDVLGKFDSGVSISQTAERTKYRGTRRLVQRFLLRRERLHRILNILDFLPRHYSEAIDFDKKFGQFKPEREEKLSFYKNESGKNQFLFLESHQEMFSEFKLTHPDLKQVPYDWTIYYLRKKALTQKISKEELAWIILNFNQKRGYYQLRGEEEEVNKNKLEEFHTLVIVDVIEREKGKSGVWYNVILENGWIYKRESKIALFDWIGKQKNFIVTTELNDDGTIKLNKDNEEKRSFRSPKEDDWGLRKIRTEQTINQSEKSVGSFIYDELLKKPNQKIKGELVRTIERKFYKDELSKILKAQITFHYEILGDRNIYKKCIDELYRHNDSHKNNIKDKGFDYLFLDDIIFYQRPLKSKTSLISDCSLEFVPIKDKKGILVKDSNGKQVVKPLKCIAKSNPIFQEFRLLQFVKNLKIYKKEIINEIDVTNDYLKTEEDLVELFDWLNDKAEISQKQFLAYPKFKLKEDKYRWNFVEDKIYPCNETRNQFLNAIAKIDVNKSFFDAKNTQDLWHILYSVTDKTELFSINTETGIQSGALSTFAKRHNLSNEFVSNFSKIKPYNKDYGSYSEKAIKKLLPLMRFGSNWNKNNIDAKTLARIDKLQTGEFDETMRTRVREKAIHLSKITDFQGLPLWLASYIIYDRHSEASNISKWKTPEDIAWFLNPKNKSGFKQHSLRNPIVEQVITETLRVVKDIWQHYGEGKENFFNEIHIELGREMKNNANDRKRITETINQNENTNLRIKAILTELKNDGINDVRPYSPSQQEILKIYEEGVYNSEIRKEKLEDIDKIRKNAKPTPSEIIKYKLWLEQGYISPYTGKLIPLSDLFTTKYQIEHIIPQSRLFDDSLSNKVICESEVNDLKGNNTALEFILKNEGRIVLLTGGKTVKIFTKEAYNQHITSYYIKNKSKQKRLLTEEIPEKFIDRQLNDTKYISKIVKNLLSKIVREEDEQEVTSKHIVSLNGSITSRMKQDWGLNDVWNKIVSPRFERLNAITNSNDFGKLELKKDEFGNAGKQVFQTTVPDDIAKGFSKKRIDHRHHALDALVIACINRTHINYLNNLNAKDENDKTIKHELRNKLCFKTKPDSNGNSKWEFHKPWENFTKKVEDELNQTIISFKQNTRVINKTVNKYQVWKEEDGAMKKVTVKQTKGDNWAIRKPIHAETVSGKVFLKRIKQSHITIANAIEQIELIVDKEVRKQLKAKIKQYPNNKEGFKKHLKAFPIMINGKAIDKVQIYETIEATATRERNNLDITFDEKKIEKITDTGIQKILLNHLKQEIYQNAIDESGKKIAPHEVAFSEIGIDELNKNIKVLNNGKNHQPIKKVRIFEESKRFSLGQSGSKTDKYVETAKGTNLFYAIYEGKKGNRNYKTIPLNEVIERQKQGLNSALVTDENENRLLFTLSPNDLVYIPTNEEKKNLTTINFDKLSREQTERIYKFVSCTSGEGHFVSNNYSKEIISNENGSNNKNERMLEFNNSNTIYDEKEKPVMIKSVCWKLEVDRLGKIKRIIR

SEQ ID NO: 1342 - protein, 1558 aa, Artificial Sequence
  Cas9
MKKILGLDLGTNSIGWALVNVDKNGNPFGIEGLGSRIIPMDQATLSDFEKGNSKSQTAERTMFRGARRLRERKHLRRERLHRILNELNFLPIHYRSCIDFVHRLGKFKANHEPKIAWRSNDQDKMEFIFQNSFLEMMSDFTKRQPELVKEGKKIPYDWTIYFLRKKALGQRIEKEELAWLLLHFNQKRGYYQLRGEDEIDATRSAKTRKYFDRKIIKSIIDTGEEYKGLKVLIVELDNGNQGKIFKQEVPDWVGQEKNIIATVDLDKDGKDRFDKGVLSQRFSIPSDSEWETEWKLIKLKTEEDLEASQKTVGTYIYDSLLKNPNQKIKGKLVRTIERKYYRDELRAILNKQREFHPELNDKKLYQHCIFSLYPQNEAFRNSIANKDFTYLFLEDIIFYQRPLKSKKSTINNCAYEVRRYMDKETKELKEVPLKCIAKSHPIFQEFRLWQFISNLRIYKKDITDIDVTNDFLHSQDDYANLFEWLNNKNEIDQKAFLKYPAFGFKKDAVNYRWNYVEDKSYPCNKTRSAILSKLDKHEQEFLTKELELKIWQLLYSVNSKEEIDKALNVNSPKINNKISIDHTGILHELKSSSLSDISIQRLKAINFEEKDYGSYSYKAIKKLLALMRQGKYFDNTAITDATKARINSIFDRLESISFDPERINSISDDDIPKQILKSFIKLNRTYGGFNTYQACYAVYGRHSEAKEIAKWEKPEDIDQYLAKFKQHSLRNPIVEQIITETLRVVRDIWKKHAYKTINKDNQGNNCESESELTEIHIELGRDMKNNKSERLRISRINSENENTNLRIRKLLIEFNDPEFGVENVRPHSPSQQEILRIYEDGVLKSGVEIPEYVDNIIKKFKETDVKKQPSKSEVLRYKLWLEQKYRSPYTNEVIPLGKLFTNDYQIEHIIPQSRYFDDSFSNKVICEAEVNQLKENELGCEFIMNNGGRIVELSFGKTVRILDFEAYEQFVQQNYAGNRPKLRNLLMTEIPNDFIDRQLNDSRYISKVVKGLLSNIVREDGEAESTSKNLISCTGGVTARLKMDWGLNDVWNNLIYPRFERLNELTNSNQFGYWDKKDGKNVFQTQVPMDIQKGFNKKRIDHRHHALDALVIACATRSHINYLNNESAKSNSKESRYDLRRKLRRLEVIQKEYTINGRKEIRNIEVAKEFYKPWNSFTQDAQSALENIVVSFKQNLRVINKTTNYFLRFNKEGKKIFETQTSGSNWAIRKPLHKDTAFGLVNLKRTKTVSLANAILDYDQIVNRKLWTKIKELISIGYDNKRILKYFTDDKENWNEIISSGIEVFYYTDNFEKQVATRKPLDTSFTESKIINSITDLGIHKILLAHLRANEGNPNIAFSPEGIETMNRHICELNGGKFHHPIYKVRVHEPLGYKFKVGDKGNRSTKYVEAAKGTNLFFGIYINSQGIRSYETIPLNVAIERQKQGLSPVPDNNELGERLLFWLSPNDLVYLPTSDEVESGICCNKLGIDRIYKMVSCTGYVGDFIPAHIANPIIQTLELGSNNKAQRAWTGEMIKEICIPVKVDRMGNIVEIFNRNKN

SEQ ID NO: 1343 - protein, 1564 aa, Artificial Sequence
  Cas9
MAKILGLDLGTNSIGWAIVDDKNSKILDTGVRIFPEGVVAKTIGSGDKEESKNAKRRESRQTRRGFYRKRLRKIKLLRTLINFKMCPLEHFELDVWSKWDKIKKKEGRMAPELFLPENSAYNLWLKQNPYILRDKALSKDLTLTEFGRVLYHLIQRRGFLSNRKGKDDGKIYGGKEGIVGIDKTNEQIKNSTLGKFLFKILPKEGEPFKIIEDELGNELRVRSRYTLRDMYIAEFEAIWNRQAKHLGLDNIYYSNVKNVLLKGSLKNKKNERKINHLKKIKGNGNIEIITLNNNLSKNEKPKYLLKIATKLPLKEFLAGRIEKDEDGKIKFKSNESVLFWQRPLRSQKKLLAKCRFEPDLKDDNGKFIQKGKTPCHLSHPLYEEYRAYQYVNNIEYGKKQRLEESQRKQVIDLINSKDGNFKFSEIKKKLKLSYETFNYSDDSSVNGNYMIKNLNSIFPKEILEKEFVVNVNKEDIIEYGYERIWHLFHFCEDNDVLIKKLQDNFDLSENDIEKISKINLKEGYSNVSLKAIKNILPYLKEGKLLSDAVILGGVRNVFGKKWHEFIDFHEKIEKDILYINHQKSNKEGEAIEKIKKYLIDYKFGFTENDNRFKKLYHHSQDVVEVKLQKKIGPVEDLRNPIVQQGVNEVRRLVNELLDVHGKFDQVRVELGRDLKNNKSKREEIGYKIRENTAKNEKAKELLIEYGLRQSRDNVQKVLLFQEMLDRGTVAVCPYTNKTINISDVLGNENKMQIEHIIPKSISLDDSFANKTLCDSKFNGLKGERTPYEFYQINNDANLWGGSKSWEEIERRTFRILPYSKAKRFTSKTKFETNDFIQRQLNDTRYISKKTKEILSQICEDVRVMPGSLTAELRKLWGLNNILHPAFVLDLPALHIDANKHIPHYVVLDEDNVPILSQRIYNDKPILKANQTSITGFVDNEIFKSKEKYVKFEVKAPNLSNGEYWAKLLLSNPKSIVRVFKEKPKSTENEIVVRGKIEKEKFKHEGLSGINAEGKENGTYWAKLSIVDKKFKKPKKDDQPKKNGKQILLFGAVKEGVFSSYMYECDADLEDGKYWLILDIDFENVEFEKALNERPEVLENQILIQGITNDENVFVSDMDCQHQFLMNEGKGKYYVLFDIISEVNEFYPIKTKSPELENGQSLTEGTIWVDKYTGEIKFDPKKNREDHRHHAIDALVIALTKETYFQQLSRRNASSENKKRGNEYEKEQLDFAEPWKEFHVDAQKSINSILISHKQNKNILTKITKKITKNGKTYKSEGMSVRGQLHDKTYYGHNKNCKADEYVYRVDINNLSFSQLTNIIDLNLKAVIVEGVIKKFEESEKLLFKKMNSKVQNLDKSKVKKIKAKVDKILKETSFFMPNEGKRYIRLNIIEPANFERMPVPIKKVRIRKVLRNAEKLNNEIKQFVDPQNNHHVLIYKDENGNLKEEVVTFWTVVERKRTGEPVYKLPSDGKKIVTTLQINDMFLLGLNEDEINWENPNYNHLKEHLYRVQKFTSGDFYFRIAKTSSIQNGEEKQQINSFGLGKNGWLTHNPIKVKISVSGKILKV

SEQ ID NO: 1344 - protein, 1570 aa, Artificial Sequence
  Cas9
MENSNNSSKKYYLGLDMGTDSCGWCVTDDKYNIIRSHKKIYGPDGKLVKREGCHLWGSRLFRPANTAKSRRLNRTARRRLARRRRRIILLRELFQPEIDKVDPNFFRRLDQSNLWNEDKDKELQMEHNFLFNDKDLTDKEYYKDFPTIYHLRKAMVNGLTINGYYYDPKKQFDIREVYLVLAHMIKYRGNFLMEGDVKDSVVDPTYLKQCFDNIDVILISLNNGEDDENEDDKIDPSECCFNVDEKKARKLANNFQETNKVSDLEDDERDLFGKFNSKDIRKKILKLINGGSGVKLKDFLPKEILVAHDGDDEYGDKKIDLSSETLEDDINGYSLPESYVEIILEAKKIYDFKTLAYLLHGKSLLCDAMVNVYEEHKEQLAALKRLYKKYATKEQYYFMFRDSRILDGDDSDDEEDKEESNKEESKDKKKKASYVSYIGYTKTNSKAKYTGAHITSEKNISALIKQIKDDLKFDDLKSKVDDPSQQNELSDEDKLDIQCIEEAIESNTFLPRQNSRNNGAFPYQLNLNEMRTIIENQSKYYPFLKDKAPSFPDGKTEEYKIVSLLKFKIPYYIGPLSQPNDYVRDDKRDNHWVQFRGENNQGIINPWNFSQIVDLEGTADKFISNLTNYCTYIFGENTLPKESLIFQAYKVLNDLNNLKVNGSLISKEDKDYIIQNVYLKKKKIKGKDIVNALKNKYKLSDEDPTVTTKGSGKSIGEDEVDLTMFNSSLSSFIDMSDPNAFGPEFYKDSNKFELAEKVIELITIVEDKDLLKERLKKLGLSDNQVNYLFKQKYSGWAPLSRKLLDGITIDCVNENTGEAYPVTIIDVMRDTPLNFMEIYETKESQFSGFKEKVAELNDEKKLSRDDLIEESYASPAMKRSVRQTFKVIDELKNTLNIDHFDRIFVEATRAPGEAGKMVKSRKKQLQEAYDAAKDLVDQESRDDLQKLRDDLEKQTDDQLRRKKVYLYFMQLGRSVYSGEKIDLNELDKNYDIDHIIPQAKLKDDSFNNMVLVERELNNKKQDEYPIPSTIISEHGRNWIQKLAKIQDKNKRSYFMPKDKANRLLRPESKQLTSDELNGFINRQLTLTNQSVKAVCDILKMTEKGSEIVYSKANFVSDFRKLCGELRPSYDAFVKVRDINDFHHANDAYLNIVVGNVYYEKFKNFYINNRIDYDNNGKKDLSVLASKLFTKTQADDKTGNIYWEARFHNEKETDSNGKERTIKVRDEGTESTFDKIEYYMELNDPLVTQMQYTLSGKQGFFKKITLKTKAKDNEDNSDKLFPLKQYLRSDSNKVMDVNKYGGYSDMITPYFMLVQSEGKKGKHIYSLESIPTIYLKSFKKKEEDIINYLSCKNKLKNPVVISDKLLMRTIVKIPYFKNDSNLSLVKLGTSGRTGNNIIYINLSELILPIEWKNYYRKISNLLGTNVSSTKPKDLSKFTEQMKNDPTSTLVDGSNKVEHDKNNRFFSYLINNVINKPIFEGLPKTSCSFIKLESKYDEFCSLNTLEQAKIIATIIKLLSCKSVQGCKLSNLSGLPSSLGALISNKALTEGTIISKESSCGLKENIIFVVPND

SEQ ID NO: 1345 - protein, 1688 aa, Artificial Sequence
  Cas9
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 1346 - protein, 1307 aa, Artificial Sequence
  Cpf1
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 1347 - protein, 1300 aa, Artificial Sequence
  Cpf1
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 1348 - protein, 446 aa, Artificial Sequence
  Cpf1
MKPDIKDREYMYRLIIGQLFYDGHQQIAVNLANTLGCSAPPPPPSDKLFRLVTIAKQFVEDPDYKAEENTMPMQFETSSAGLDLQYDADVAATSPEPSQYETIYLTVHKAPCRAAAFNSDGSLIATGSADCSIKIMDVERILAREKEHREMNENGPDAHHPVIRTLYDHVDVRRDFGRFSDKILDFQDVNTVIFHPRDAILISGSNDKTVKLFDFSKTAVKRAMKTLSEVYPVRALSCHPGGEFLLVATDHPTVRLYNIETAQAYASANPDDQHRESVTDVHYSENARLYVTASKDGDVKVWDGVSSRCVETFKRAHDGSSICSAKFTKNGKYILTSGMDSIVKLWELSTNRCLIVYTGAGATGAQDYPTSASFNQNEDFVLFPDEKSGSMCSWEARNADRKRLLALGHTSACRTFVHSPSMPAFMTGSDDHRARFWYRKPTTNDN

SEQ ID NO: 1349 - protein, 430 aa, Artificial Sequence
  Cpf1
MKPDIKDREYMYRLIIGQLFYDGHQQIAVTLANTLGCSAPAPPPSDKLYRLVTIAKQFVEDPDYKAEEKSLPMQFETVSTGLDLEYDADVQPVSPEPSQYETIYLTVHKAPCRAAAFNSDGSLVATGSADCSIKIMDVERILAREKEHREMNENGPDAHHPVIRTLYDHVDDVNTVLFHPRDAILISGSNDKTVKLFDFSKTAVKRAMKTLSEVYPVRALSCHPGGEFLLVATDHPTVRLYNIETAQAYASANPDDQHRESVTDVHYSENARLYVTASKDGDVKIWDGVSNRCVETFKRAHDGSAICSAKFTKNGKYLLTSGMDSIVKLWELSTNRCLIVYTGAGATGAQDYATSASFNHNEDYVLFPDEKSGSMCSWDARNSDRKRLLALGHTSACRTFVHSPSMPAFMTGSDDHRARFWYRKPATTDN

SEQ ID NO: 1350 - protein, 1228 aa, Artificial Sequence
  Cpf1
AASKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGAAGYKSLFKKDIIETILPEAADDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNAKTKQALPKFKPLYKQVLSDRESLSFYGEGYTSDEEVLEVFRNTLNKNSEIFSSIKKLEKLFKNFDEYSSAGIFVKNGPAISTISKDIFGEWNLIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFAAAKKNNVFAWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVK

SEQ ID NO: 1351 - protein, 1300 aa, Artificial Sequence
  Cpf1
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSDDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILANFAAIPMIFDEIAQNKDNLAQISLKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGNPQKGYEKFEFNIEDCRKFIDFYKESISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEHNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 1352 - protein, 356 aa, Artificial Sequence
  Cpf1
MKTNYHDKLAAIEKDRESARKDWKKINNIKEMKEGYLSQVVHEIAKLVIGYNAIVVFEDLNFGFKRGRFKVEKQVYQKLEKMLIEKLNYLVFKDNEFDKAGGVLRAYQLTAPFETFKKMGKQTGIIYYVPADFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAIYAENDKKFFAKLTSILNSILQMRNSKTGTELDYLISPVADVNGNFFDSRHAPKNMPQDADANGAYHIGLKGLMLLYRIKNNQDGKKLNLVIKNEEYFEFVQNRNKSSKI

SEQ ID NO: 1353 - protein, 1263 aa, Artificial Sequence
  Cpf1
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNLPNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDSIGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 1354 - protein, 939 aa, Artificial Sequence
  Cpf1
MNLYSNLTNKYSLSKTLRFELIPQGETLENIKARGLILDDEKRAKDYKKAKQIIDKYHQFFIEEILSSVCISEDLLQNYSDVYFKLKKSDDDNLQKDFKSAKDTIKKHISRYINDSEKFKNLFNQNLIDAKKGQESDLILWLKQSKDNGIELFKANSDITDIDEALEIIKSFKGWTTYFKGFHENRKNVYSSDDIPTSIIYRIVDDNLPKFIENKAKYENLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTLEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKYRDIDKQCRFEEIFASFADIPVLFDEIAQNKNNLAQISIKYQNQGKKDLLQTSAEVDVKAIKDLLDQTNNLLHKLKIFHITQSEDKANILDKDEHFYLVFDECYFELANIVALYNKIRNYITQKPYSDEKFKLNFENSTLANGWDKNKEPDNTAILFIKDDKYYLGVMNKKNNKIFDDKAIKENKGEGYKKVVYKLLPGANKMLPKVFFSAKSINFYNPSEDILRIRNHSTHTKNGSPQKGYEKLEFNIEDCRKFIDFYKHSISRHPEWKDFGFRFSDTKKYNSIDEFYREVENQGYKLTFENISESYIDSLVDEGKLYLFQIYNKDFSVYSKGKPNLHTLYWKALFDERNLQDVVYKLNGEAELFYRKQSIPKKITHPAKEAIANKNKDNPKKESIFEYDLIKDKRFTEDKFFFHCPITINFKSSGANKFNDEINLLLKEKANDVHILSIDRGERHLAYYTLVDGKGNIICKN

SEQ ID NO: 1355 - protein, 1264 aa, Artificial Sequence
  Cpf1
MLFQEFTHLYPLSKTVRFELKPIGKTLEHIHAKDFLSQDETMADMYQKVKAILDDYHRDFIADMMSGVVLTKLAEFYEVYLALRKTPKDDSLQKQLTEIQTALRKEIVKPIGSGGKYKAGYDRLFGAKLFKDGKELGDLAKFVITQEGESSPKLAHIAHFEKFSTYFTGFHDNRKNMYSDEDKHTAIAYRLIHENLPRFIDNLQILATIKQKHSALYDQIVNELNANGLDVSLASHLDGYHKLLTQEGITAYNTLLGGISGEAGSRKIQGINELINIHHNQHCQKSERIAKLRPLHKQILSDGMGVSFLPSKFADDSEVCQAVNEFYRHYAHVFAKVQSLFDRFDDYRKDGIYVEHKNLNELSKQAFGDFALLGRVLDGYYVDVVNPEFNERFAKAKTDNAKEKLTKEKDKFIKGVHSLASLEQAIEHYIAGHDDESVQAGKLGQYFKHGLAGVDNPIQKIHNSHSTIKGFLERERPAGERALPKIKSDKSPEMTQLRQLKELLDNALNVVHFAKLLTTKTTLDNQDGNFYGEFGALYDELAKIATLYNKVRDYLSQKPFSTEKYKLNFGNPTLLNGWDLNKEKDNFGVILQKDGCYYLALLDKAHKKVFDNAPNAGKSVYQKMVYKLLPGPNKMLPKVFFAKSNLDYYNPSAELLDKYAQGTHKKGNNFNLKDCHALIDFFKASINKHPEWQHFGFEFSPTSSYQDLSDFYREVEPQGYQVKFVDINAEYIDELVEQGQLYLFQIYNKDFSPKAHGKPNLHTLYFKALFSENNLANPIYKLNGEAEIFYRKASLDMNETTIHRAGEVLENKNPDNPKKRQFVYDIIKDKRYTQDKFMLHVPITMNFGVQGMTIKEFNKKVNQSIQQYNDVNVIGIDRGERHLLYLTVINSKGEILEQRSLNDIITTSANGTQMTTPYHKILDKREIERLNARVGWGEIETIKELKSGYLSHVVHQISQLMLKYNAIVVLEDLNFGFKRGRFKVEKQIYQNFENALIKKLNHLALKDKADDEIGSYKNALQLTNNFTDLKSIGKQTGFLFYVPAWNTSKIDPATGFVDLLKPRYENIAQSQAFFGKFDKIFYNADKGYFEFYVDYAKFTDKAKNSRQTWVICSHGDKRYVYDKTANQNKGATIGINVNDELKSLFARYHINDKQPNLVMDICQNNDKEFHKSLMYLLKALLALRYSNASSDEDFILSPVADDKGVFFNSALADDTQPQNADANGAYHIALKGLWLLNELKNSNDLDKIKLAIDNQTWLNFAQNR

SEQ ID NO: 1356 - protein, 1300 aa, Artificial Sequence; identical to SEQ ID NO: 1351
  Cpf1

SEQ ID NO: 1357 - protein, 1251 aa, Artificial Sequence
  Cpf1
MNHMKQFTNQFSLSKTLRFELIPQGKTKEFIEINGLIEKDNERAVSYKKVKKIIDEYHKYFIEMVLCDFKLHGLETYETIFNKKEKDDTDKKEFDNIRNSLRKQIADAFAKNPNDEIKERFKNLFAKELIKQDLLNFVDDEQKELVNEFKDFTTYFTGFHQNRRNMYVADEKATAIAYRLVNENLPKFIDNLKIYEKIKKDAPELISDLNKTLVEMEEIVQGKTLDEIFSLSFFNQTLTQTGIELYNIVIGGRTADEGKTKIKGLNEYINTDYNQKQTDKKKKQAKFKQLYKQILSDRHSVSFVAETFETDAQLLENIEQFYSSVLCNYEDDGHTTNIFEAIKNLIIGLKTFDLSKIYLRNDTSLTDISQKLFGDWSIISSALNDYYEKQNPISSKEKQEKYDERKAKWLKQDFNIETIQTALNECDSEIIKEKNNKNIVSEYFAKLGLDKDNKIDLLQKIHHNYVVIKDLLNEPYPENIKLGNQKEQVSQIKDFLDSILNLIHFLKPLSLKDKDKEKDELFYSLFTALFEHLSQTISIYNKVRNYLTQKAYSTEKIKLNFENSTLLNGWDVNKEPVNTSVIFRKNGLFYLGIMSKSNNRIFERNVPVCKNEETAFEKMNYKLLPGANKMLPKVFLSAKGIESFQPSAEIQSKYQKETHKKGDAFVRKDMENLIDFFKQSIAKHTDWKHFNHQFSKTETYNDLSEFYKEVEKQGYKLTFTKLDETYINQLVDEGKLYLFQIYNKDFSPFSKGKPNMHTLYWKMLFDEQNLQNVVYKLNGEAEVFFRQSSIKQTDRIIHKANQAIDNKNPLNNKKQSSFNYDLIKDKRFTLDKFQFHVPITLNFKAEGNEYLNTKVNEYLKSNSDVKIIGLDRGERHLIYLTLINQKGELLKQQSLNVIATSQEHETDYKNLLVNKENERANARQDWKTIETIKELKEGYLSQVVHQIATMMVDENAIVVMEDLNAGFMRGRQKVERQVYQKLEKMLIEKLNYLVFKNNDVNETAGVLNALQLTNKFESFEKMGKQSGFLFYVPAWNTSKIDPATGFVDFLKPKYESVEKAKLFFEKFESIKFNADKNYFEFEFDYKKFTEKAEGSQTKWTVCTHSDVRYRYNPQTKASDEVNVTNELKLIFDKFKIEYKNGKNLKTELLLQDDKQLFSKLLHYLALTLMLRQSKSGTDIDFILSPVAKNGVFYDSRNAMPNLPKDADANGAFHIALKGLWCVQQIKKADDLKKIKLAISNKEWLSFVQNLK

SEQ ID NO: 1358 - protein, 1390 aa, Artificial Sequence
  Cpf1
MIDNTKEKKEGSVFDGFTRKYQLSKTLRFELRPILNTPKMLDDEQVIKNDETRRKKYEAVKPWFDQLHREFIEDALKSFKFKNLAIYQDTFQTWQKDRKSKQKKDTLVKIEVGLREEIVRRFEEVANIWVRSEQYKLLGIKKEGLGMLFEAGVFRLLKERFKNEKDTTVDGNNIFDEWTRWTGYFKKFFETRKNFYKSDDTSTAIAYRVINQNLRRFCENIQIFEKISEKIEFSEVEKSFDISCAGIFSLAYYNACLLQGGIDTYNKIIGGEVDEKDKKIPGINELINKYRQDNSGEKIPFLKQLDKQIHSAKEAFIESIETNKELVGKLKTFYENAEVKIQSFRNLIADIVTDYSGYDIDKIYLTKEAVSHNASRWFASFESFERDLFAVVAEKQNKLVYELLRTHKNDSKISDKDGKFSFPDFIKCSHIKRALEKQEGRIWKGEYYEDIVDFEKIKDVFTQFLCVFKFELEQQFFRKTTSAQTGEQTKIGYEIFVTKINELITRENPVIDLEEKIAIKNFADATLLIYQIAKYFAVEKRRGWLDNYDLDDRFYKSSDIGYLNFYRDAFEQIVRPYNLFRNYLTKKPYNTNKWVLSFENPTLADGWDKNKEKTNAAVILRKDGRYYLGIIKEDCKSLFADRYSKEMSEGIESGSFQKMAYKFFPEASKMIPKCSTQTKNVKEHFRKSSSDYNLFHEKDYKISVAITKNIYELNNVFYRKDNIEESFVPKNDFEKKLGVKKFQRQYLEISRDNNGYKQALAQWIEFCIRFLKAYKSTTIFDYSRLREAKEYESLDAFYQDINALTYNISFVPISEQYIKEKNDNGELFLFEIYNKDWSLGPMDKNRKRTKNLHTLYFEQLFSKENEQENFLFQLNGEAELFFRPKTEEKRLGYKVWDAGEKKWVKAKEKEDGAVIDRKRYAKDIILFHCPITLNRVSESKTKREMDVEIREVLSSTPGVHIIGVDRGEKHLAYYSVIDQNGKIIETDTLNSIGKDGRGKPVEYASKLEKRAQEREASRRDWEEVEAIKDLKKGYISQVIRNLADLIIKHNAIIVFEDLNMRFKQIRGGIEKSAYQQLERALIDKLSFLVKKGEEDPKQTGHILRAYQLAAPVIAFKDMGKQTGLIFYTQAGYTSKTCPECGYRRNIKCLFENIEQAKTLIENLESINYNKKEDVFQISYSLEKLSSKDQKKEKKVSNELYAKTLKKDIFILTTKNALRYKWYDRYSEKAKVAKRGIDEYKGEVNESETKKGVVKEFNLTEYLKGLLKTYEIDYEHGGIREQILSVARGREFYKDFLYALFLLTETRHSISGRNTDYIQCPECEFDSRKGFKDIKEFNGDANGAYNIARKGIMILEKIKQFKKDNDGNLEKMGWGDLSISIEEWDKFTQKE

SEQ ID NO: 1359 - protein, 1341 aa, Artificial Sequence
  Cpf1
MNAEKKCAFNEFTNLYELSKTLKFELKPVGKTKEIIKNFREELEKNNPIQLDKEISIAKQEIKKDLDILHREFVRQSFELAFKENKINYEIFFEIYRNFKKFSKNKKSDEYIAAIKNLKEEKIKLVKKIADYFVKMDQEWRKYYPSEKKSFLLMSNGVINLLIDINKDRMDYSFIPKEVCEKIKGKGKIELYEKFNKHFGYLSKYNTARENFYSDDVKNSASVAYRAICENLEKFCDNKIKVEADNFPKEIKEKFLEYFNKITDLSFYNRCLSQNGIEEYHKFKDEINRSINELYPNNSKNKPQNIPYLSKLDKQILSEKDKQSWIEEGFIDENNFIFEFEKFIKMNDKYIPSEKKLFNEFFIFQNNDEVLQKLFLLKKTINNFANIYLDDPKNLMDLMPSKGTKKRDYLSLLEIKEALNSYAENQNIGETQIFKIKYDDVIDKTKTPFECFMKIWKYEYDLLYNEGDGKKNIEEGWEKICEKLQNKKDEFTGDYGKYKKEIKDYCEMALSLSQRIKHLDIRIKKRDGSEDADNNLFEGVEKLDEFYDRLFEIVDEHNAYQYHHEFQAFLTKKPYKTDKFKLSFDNPQLLKGWDLNKEPDYFGALLVKNEKYFLAVFHKQYANEIFRQKNKNSTVKIKEAYDVFNGNYYKKVELKQIPKLFMNLPRICFAKSNQEEFGLTIELEKIKSEFDKFQKLKKERQDNNLKFDQEKFIKLLAYYRHCLEIREDWKVFKYNFKPLYKYSNLGEFYRDLEKDTYNLDLVRVNSEYVEKKRNEGKLYLFEVYNKDFSDKSIGRKNIHSDYFKSLFLPDNLTNKKIALAADAEIFFREKSLKNKDEIITQKNKIKIDKNNHKGEKAYSKNRYTDDKIILHLPINLNFGENKNHKDFNYEINDSLLKNNRDIKIIGIDRGEKYLLYYSVIDQKGDIKEMGDFNVVNGVDYYSKLVAYEEKRKQARLDWGDIQSIKELKEGYISHVIHEICDLIKKYNAIVVLEDLSMGFKRGRFFRERQVYQKFELALFRKLNYWVDKNKEEGEKGSALSAWQLTPNEKDFKVSQLEKARQLGILFYTAAGYTSKTCPDCGFRKNITLKYVNDKQLKEDLGKLKINFVEDHFKIKYNLLDFEKNKKSEKAKDTVLPKEERKISFVANSKVIRIRWHDIKTKLAKRELDGEKIIKKFPKGVIKEYDINICLKRIIGDKIDFSKDSITEQLINGRFGKDFYWELMYFLNLILEIRNVVSETEIDYIQCPVCGFHSDDGFRGNKFNGDANGAYNIARKGRLILEKINQHKNLKELKTGDLSVNIVEWDKAVNNWDKFVQGDNTESKNIEIPAKEEMISVEVRES

SEQ ID NO: 1360 - protein, 1368 aa, Artificial Sequence
  Cpf1
MKKEKEFKSFGDFTNLYEISKTLRFELKPVENTQTMLDEADVFGKDKVIKDKYTKTKPFIDKLHREFVDESLKDVSLSGLKKYSEVLENWKKNKKDKDIVKELKKEEERLRKEVVEFFDNTAKKWANEKYKELGLKKKDIGILFEESVFDLLKEKYGEEQDSFLKEEKGDFLKNEKGEKVSIFDEWKGFVGYFTKFQETRKNFYKNDGTETALATRIIDQNLKRFCDNIDDFKKIKNKIDFSEVEKNFNKTADVFSLDFYNQCLLQKGIDSYNEFIGGKTLENGKKLKGVNELVNEYRQKNKNEKVSFLKLLDKQILSEKEKLSFGIENDEQLLVVLNSFYETAEEKTKILRTLFGDFVEHNENYDLDKTYISKVAFNTISHKWTNETHKFEELLYGAMKEDKPIGLNYDKKEDSYKFPDFIALGYLKKCLNNLDCDTKFWKEKYYENNADKKDKDKGFLTGGQNAWDQFLQIFIFEFNQLFNSEAFDNKGKEIKIGYDNFRKDFEEIINQKDFKNDENLKIAIKNFADSVLWIYQMAKYFAIEKKRGWDDDFELSEFYTNPSNGYSLFYDRAYEEIVQKYNDLRNYLTKKPYKEDKWKLNFENPTLANGFDKNKESDNSTVILRKKRKYYLGLMKKGNNKIFEDRNKAEFIRNIESGAYEKMAYKYLPDVAKMIPKCSTQLNEAKNHFRNSADDLEIKKSFSNPLKITKRIFDLNNIQYDKTNVSKKISGDNKGIKIFQKEYYKISGDFDVYKSALNDWIDFCKDFLSKYDSTKDFDFSILRKTKDYKSLDEFYVDVAKITYKISFTPVSESYIDQKNKNGELYLFEIYNQDFAKGKMGAKNLHTLYFENVFSPENISKNFPIKLNGNAELFFRPKSIESKKEKRNFVREIVNKKRYSEDKIFFHCPITLNRETGSIYRFNNYVNNFLSENNINIIGVDRGEKHLAYYSVIDKNGVKIGGGSFNEINKVDYAKKLEERAGEREQSRKDWQVVEGIKDLKKGYISQVVRELADLAIKHNAIIVLEDLNMRFKQIRGGIEKSIYQQLEKALIDKLSFLVEKGEKDPNQAGHILKAYQLAAPFTSFKDMGKQTGIVFYTQASYTSKTCPNCGFRKNNNKFYFENNIGKAQDALKKLKTFEYDSENKCFGLSYCLSDFANKEEVEKNKNKKRNNAPYSDIEKKDCFELSTKDAVRYRWHDKNTERGKTFFEGESVYEEKEEKEIGQTKRGLVKEYDISKCLIGLFEKTGLDYKQNLLDKINSGKFDGTFYKNLFNYLNLLFEIRNSISGTEIDYISCPECQFHTDKSKTIKNGDDNGSYNIARKGMIILDKIKQFKKENGSLDKMGWGELFIDLEEWDKFAQKKNNNIIDK

SEQ ID NO: 1361 - protein, 1382 aa, Artificial Sequence
  Cpf1
MSKNNVWDKFTNQYSLSKTLRFELKPVGKTREKMNEQLKYDKQLQTFLKDQEIEDAYQYLKPFFDKLHKEFITDSLDSDTTKKIDFSDYLIDYRDKKDLTKKEDSLRKNIGEVFVKAGDRWKKEKYPKYEWKKGSNVANGSGILLTQDVLMLIKDLNPNDQKIKKMIEETFKGFFTYFSGFNLNRENYYTTKVEKATAVATRIVHDNLPKFCDNLVQFECIIKKKKNGEVDRIERKSEYLNAYQYLKSKGRTTQIKDAESGKMIEAEVINENMFSISYFSACLSQSGIEEYNRTIGHYNLLINLYNQAKEGEEKDLKKSEKKFKRLPIFKTLYKQIGCGEKEPLFFSLTHDTKLQVQENKENYKKPYSVEQILEQAKLAGDKYFKGKSNDGILNTIPEFSDYILQKESYGGVYWSKVAINTISNRYFENWHTLKDALIDAKVFEKGKKGDEEDVKIPESIELQGFFDVLDTQEGWKSEGIFFKKSLTEELKNKEADTKNKKRREIVKEAKRPSQALLALLFDDIQEHANLFLNQSDEILKLEKYSEKESKEKIKQWMDSALAVNRILKYFFVKESKAKGEQIDPIISEALKVLFNSEDATWFKWYDALRNYLTKKPQDDVKENKLKLNFENSTLAGGWDINKESDNYCVILQDQKGKQHLGIIAKKEKQRGYNKIFERTPENPLYKIDSGEVWQKMEYKQIAVPTGIGGFVRKCFNTAQQYGWKCPDNCLNSEGKIIIKNDEAKENLEAIIDCYKDFFTKYEKDGFKYKNFNFNFKESEEYEELNSFFSDVERQGYKLGFITVNKTIIDKWVEDGTIYLFEIKNQDTNDGKKDGHKNNLHTIYWKALFEDVGNKPKLNGGAELFYRKALLKDKQEKIEDNYGKEIIKNFRFSKEKFLFHCPIKLNYKAKSYSHPKYALPEINKQTNEFFITISDICFLGIDRGEKHLAYYSLVNQKEEIIDQGTLNMPFVDKDGKPRSIKKEKFRFDAKVDKWVSEEMDCWNYNDLLDAMASNRDMARKNWQTIGTIKELKNGYISQVVRKIVDLAIDKNRGIPSFIVLENLNAGFMRGRQKIEKSVYQKLELALAKKLNFVVDKTVQNGEIGSVTNALQLTPPVTNFQNIENRKQVGIMLYTRADYTSQTDPVTGWRKSIYLKKGSEEYIKSQIMDSFDDFGFDGKNYYFKYTVDLIDPIKKTSEKKFKKQWTLYSGINGKSLDRFRGERSSDKNVWIKTLQDIKTTLDAVFIGFDLQHSLRSQIINDGIMPKKIENSQFTGWESLRFAIEMIQQIRNIGVEKGDEDFILSPVRDKNENHFDSRKAKENEPNSGDANGAYNIARKGIIMNEHIKKDLIPFIQDKEWDAWLAGREVWDKWLIENKDSLIYKK

SEQ ID NO: 1362 - protein, 1400 aa, Artificial Sequence
  Cas9 variant product
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPAATKKAGQAKKKK

SEQ ID NO: 1363 - protein, 1661 aa, Artificial Sequence
  Cas9 variant product
MAPKKKRKVGIHGVPAANFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNNKRPAATKKAGQAKKKK

SEQ ID NO: 1364 - protein, 1085 aa, Artificial Sequence
  Cas9 variant product
MAPKKKRKVGIHGVPAAKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGKRPAATKKAGQAKKKK

SEQ ID NO: 1365 - protein, 1441 aa, Artificial Sequence
  Cas9 variant product
MAPKKKRKVGIHGVPAALFNKCIIISINLDFSNKEKCMTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEGKRPAATKKAGQAKKKK

SEQ ID NO: 1366 - protein, 1133 aa, Artificial Sequence
  Cas9 variant product
MAPKKKRKVGIHGVPAAWYASLMSAHHLRVGIDVGTHSVGLATLRVDDHGTPIELLSALSHIHDSGVGKEGKKDHDTRKKLSGIARRARRLLHHRRTQLQQLDEVLRDLGFPIPTPGEFLDLNEQTDPYRVWRVRARLVEEKLPEELRGPAISMAVRHIARHRGWRNPYSKVESLLSPAEESPFMKALRERILATTGEVLDDGITPGQAMAQVALTHNISMRGPEGILGKLHQSDNANEIRKICARQGVSPDVCKQLLRAVFKADSPRGSAVSRVAPDPLPGQGSFRRAPKCDPEFQRFRIISIVANLRISETKGENRPLTADERRHVVTFLTEDSQADLTWVDVAEKLGVHRRDLRGTAVHTDDGERSAARPPIDATDRIMRQTKISSLKTWWEEADSEQRGAMIRYLYEDPTDSECAEIIAELPEEDQAKLDSLHLPAGRAAYSRESLTALSDHMLATTDDLHEARKRLFGVDDSWAPPAEAINAPVGNPSVDRTLKIVGRYLSAVESMWGTPEVIHVEHVRDGFTSERMADERDKANRRRYNDNQEAMKKIQRDYGKEGYISRGDIVRLDALELQGCACLYCGTTIGYHTCQLDHIVPQAGPGSNNRRGNLVAVCERCNRSKSNTPFAVWAQKCGIPHVGVKEAIGRVRGWRKQTPNTSSEDLTRLKKEVIARLRRTQEDPEIDERSMESVAWMANELHHRIAAAYPETTVMVYRGSITAAARKAAGIDSRINLIGEKGRKDRIDRRHHAVDASVVALMEASVAKTLAERSSLRGEQRLTGKEQTWKQYTGSTVGAREHFEMWRGHMLHLTELFNERLAEDKVYVTQNIRLRLSDGNAHTVNPSKLVSHRLGDGLTVQQIDRACTPALWCALTREKDFDEKNGLPAREDRAIRVHGHEIKSSDYIQVFSKRKKTDSDRDETPFGAIAVRGGFVEIGPSIHHARIYRVEGKKPVYAMLRVFTHDLLSQRHGDLFSAVIPPQSISMRCAEPKLRKAITTGNATYLGWVVVGDELEINVDSFTKYAIGRFLEDFPNTTRWRICGYDTNSKLTLKPIVLAAEGLENPSSAVNEIVELKGWRVAINVLTKVHPTVVRRDALGRPRYSSRSNLPTSWTIEKRPAATKKAGQAKKKK

SEQ ID NO: 1367 - protein, 1420 aa, Artificial Sequence
  Cas9 variant product
MAPKKKRKVGIHGVPAATKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEGKRPAATKKAGQAKKKK

SEQ ID NO: 1368 - protein, 1114 aa, Artificial Sequence
  Cas9 variant product
MAPKKKRKVGIHGVPAAAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVRKRPAATKKAGQAKKKK

SEQ ID NO: 1369 - protein, 1366 aa, Artificial Sequence
  Cas9 variant product
MAPKKKRKVGIHGVPAAKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDDKRPAATKKAGQAKKKK

SEQ ID NO: 1370 - protein, 1377 aa, Artificial Sequence
  Cas9 variant product
MAPKKKRKVGIHGVPAAKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGDKRPAATKKAGQAKKKK

SEQ ID NO: 1371 - protein, 1088 aa, Artificial Sequence
  Cas9 variant product
MAPKKKRKVGIHGVPAAQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVRKRPAATKKAGQAKKKK

SEQ ID NO: 1372 - protein, 1114 aa, Artificial Sequence
  Cas9 variant product
MAPKKKRKVGIHGVPAAAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVRKRPAATKKAGQAKKKK

SEQ ID NO: 1373 - protein, 1116 aa, Artificial Sequence
  Cas9 variant product
MAPKKKRKVGIHGVPAAKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQKRPAATKKAGQAKKKK

SEQ ID NO: 1374 - protein, 1016 aa, Artificial Sequence
  Cas9 variant product
MAPKKKRKVGIHGVPAAARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKKKRPAATKKAGQAKKKK

SEQ ID NO: 1375 - protein, 1153 aa, Artificial Sequence
  Cas9 variant product
MAPKKKRKVGIHGVPAASDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDFKRPAATKKAGQAKKKK

SEQ ID NO: 1376 - protein, 1339 aa, Artificial Sequence
  cpf1 variant product
MAPKKKRKVGIHGVPAATQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNKRPAATKKAGQAKKKK

SEQ ID NO: 1377 - protein, 1332 aa, Artificial Sequence
  cpf1 variant product
MAPKKKRKVGIHGVPAASIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNNKRPAATKKAGQAKKKK

SEQ ID NO: 1378 - RNA, 51 nt, Artificial Sequence
  NLS2 variant
auggcccccaagaagaagcgcaaggugggcauccacggggucccggccgcg

SEQ ID NO: 1379 - RNA, 48 nt, Artificial Sequence
  NLS4 variant
aagcgccccgccgccaccaagaaggcgggccaggccaagaagaagaag

SEQ ID NO: 1380 - RNA, 4107 nt, Artificial Sequence
  Cas9 variant
auggacaagaaguacagcaucggccuggacaucgggaccaacuccgugggcugggccgucaucaccgacgaguacaaggugcccagcaagaaguucaaggugcuggggaacacggaccgccacuccaucaagaagaaccugaucggcgcccugcuguucgacagcggggagaccgcggaggccacccggcugaagcgcaccgcccggcgccgguacacgcgccggaagaaccgcaucugcuaccugcaggagaucuucuccaacgagauggccaaggucgacgacagcuucuuccaccggcucgaggaguccuuccugguggaggaggacaagaagcacgagcgccacccgaucuucggcaacaucguggacgaggucgccuaccacgagaaguaccccaccaucuaccaccuccggaagaagcucguggacagcaccgacaaggcggaccugcgccugaucuaccucgcccuggcccacaugaucaaguuccggggccacuuccugaucgagggggaccucaaccccgacaacuccgacguggacaagcuguucauccagcugguccagaccuacaaccagcuguucgaggagaaccccaucaacgccagcggcguggacgcgaaggccauccuguccgcccgccugagcaagucccggcgccucgagaaccugaucgcccagcugccgggggagaagaagaacggccucuucgggaaccugaucgcccugagccucggccugacgcccaacuucaaguccaacuucgaccuggcggaggacgccaagcuccagcugagcaaggacaccuacgacgacgaccuggacaaccuccuggcccagaucggcgaccaguacgccgaccuguuccucgccgcgaagaaccuguccgacgccauccugcucagcgacauccugcgggugaacaccgagaucaccaaggccccgcuguccgccagcaugaucaagcgcuacgacgagcaccaccaggaccucacgcugcugaaggcccucguccggcagcagcugcccgagaaguacaaggagaucuucuucgaccagagcaagaacggguacgcgggcuacaucgacgggggcgccucccaggaggaguucuacaaguucaucaagccgauccuggagaagauggacggcaccgaggagcuccuggugaagcugaaccgcgaggaccugcuccggaagcagcgcaccuucgacaacgggagcaucccccaccagauccaccugggcgagcugcacgccauccuccgccggcaggaggacuucuaccccuuccugaaggacaaccgcgagaagaucgagaagauccugaccuuccggauccccuacuacguggggccgcucgcccgcggcaacucccgguucgccuggaugacgcgcaagagcgaggagaccaucacccccuggaacuucgaggaggucguggacaagggggcguccgcccagagcuucaucgagcggaugaccaacuucgacaagaaccugcccaacgagaaggugcugcccaagcacucccuccuguacgaguacuucacggucuacaacgagcugaccaaggugaaguacgugaccgagggcaugcgcaagccggccuuccucagcggcgagcagaagaaggccaucgucgaccugcuguucaagaccaaccggaaggugacggugaagcagcucaaggaggacuacuucaagaagaucgagugcuucgacuccgucgagaucagcgggguggaggaccgcuucaacgcgucccugggcaccuaccacgaccugcucaagaucaucaaggacaaggacuuccuggacaacgaggagaacgaggacauccuggaggacaucguccucacccugacccuguucgaggaccgggagaugaucgaggagcgccucaagacguacgcccaccuguucgacgacaaggugaugaagcagcugaagcggcgccgguacaccggguggggccgccucagccggaagcugaucaacgggauccgcgacaagcaguccggcaagaccauccuggacuuccucaagagcgacggcuucgccaaccggaacuucaugcagcugauccacgacgacucccugaccuucaaggaggacauccagaaggcccaggugagcgggcagggcgacucccuccacgagcacaucgccaaccuggcggggagccccgccaucaagaagggcauccugcagacggucaaggugguggacgagcucgucaaggugauggggcgccacaagcccgagaacaucgugaucgagauggcccgcgagaaccagaccacccagaagggccagaagaacucccgggagcgcaugaagcggaucgaggagggcaucaaggagcuggggagccagauccugaaggagcaccccgucgagaacacccagcuccagaacgagaagcuguaccuguacuaccuccagaacggccgcgacauguacguggaccaggagcuggacaucaaccggcugagcgacuacgacguggaccacaucgucccgcaguccuuccucaaggacgacagcaucgacaacaaggugcugacgcgcuccgacaagaaccggggcaagagcgacaacgugcccuccgaggaggucgugaagaagaugaagaacuacuggcgccagcugcucaacgccaagcugaucacccagcggaaguucgacaaccugaccaaggccgagcgcgggggccucagcgagcuggacaaggcgggguucaucaagcggcagcugguggagacccgccagaucaccaagcacgucgcccagauccucgacucccggaugaacacgaaguacgacgagaacgacaagcugauccgcgaggugaaggugaucacccucaagagcaagcucgucuccgacuuccggaaggacuuccaguucuacaaggugcgcgagaucaacaacuaccaccacgcccacgacgccuaccugaacgccguggucggcaccgcgcugaucaagaaguaccccaagcucgagagcgaguucguguacggggacuacaagguguacgacguccggaagaugaucgccaaguccgagcaggagaucggcaaggccaccgccaaguacuucuucuacagcaacaucaugaacuucuucaagacggagaucacccuggcgaacggggagauccgcaagcggccccugaucgagaccaacggcgagaccggcgagaucgugugggacaaggggcgcgacuucgccacggugcggaagguccucuccaugccccaggugaacaucgugaagaagaccgagguccagaccggcggguucagcaaggaguccauccugcccaagcgcaacagcgacaagcugaucgcccgcaagaaggacugggaccccaagaaguacggcggguucgacucccccaccguggccuacagcgugcucgucguggccaagguggagaagggcaagagcaagaagcugaaguccgucaaggagcugcucggcaucacgaucauggagcggagcuccuucgagaagaacccgaucgacuuccuggaggcgaagggguacaaggaggugaagaaggaccugaucaucaagcuccccaaguacagccuguucgagcuggagaacggccgcaagcggaugcucgccuccgccggggagcugcagaagggcaacgagcuggcccuccccagcaaguacgugaacuuccuguaccuggccucccacuacgagaagcucaaggggagcccggaggacaacgagcagaagcagcuguucgucgagcagcacaagcacuaccuggacgagaucaucgagcagaucuccgaguucagcaagcgcgugauccucgcggacgccaaccuggacaaggugcuguccgccuacaacaagcaccgggacaagcccauccgcgagcaggccgagaacaucauccaccucuucacccugaccaaccugggcgcccccgcggccuucaaguacuucgacaccacgaucgaccggaagcgcuacaccagcaccaaggagguccucgacgccacccugauccaccaguccaucacgggccuguacgagacccggaucgaccucagccagcucgggggcgacuga

SEQ ID NO: 1381 - RNA, 4890 nt, Artificial Sequence
  Cas9 variant
augaacuucaagauccugcccaucgccaucgaccucggcgugaagaacaccggggucuucagcgccuucuaccagaagggcaccucccuggagcgccuggacaacaagaacgggaagguguacgagcucagcaaggacuccuacacgcugcugaugaacaaccggaccgcgcgccggcaccagcgccggggcaucgaccgcaagcagcucgugaagcggcuguucaagcugaucuggaccgagcagcucaaccuggagugggacaaggacacccagcaggccaucagcuuccuguucaaccgccggggguucuccuucaucacggacggcuacagcccggaguaccucaacaucguccccgagcaggucaaggccauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgcgaacuacagcgagucccugaagacccagaaguucagcuacaccgacaagcaggggaaccugaaggagcucuccuacuaccaccacgacaaguacaacauccaggaguuccugaagcgccacgccacgaucaacgaccggauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgugaacaagaucaagagcgagauggcguccggcgggcgccaccggagccaguacuuccaggagaucaccaacgugcuggacgagaacaaccaccaggagggcuaccugaagaacuucugcgagaaccugcacaacaagaaguacuccaaccugagcgucaagaaccucgugaaccugaucgggaaccugagcaaccucgagcugaagccccugcgcaaguacuucaacgacaagauccacgccaaggccgaccacugggacgagcagaaguucacggagaccuacugccacuggauccucggcgaguggcgggugggcgucaaggaccaggacaagaaggacggggccaaguacuccuacaaggaccugugcaacgagcugaagcagaaggugaccaaggccggccucguggacuuccugcuggagcuggaccccugccgcaccaucccgcccuaccucgacaacaacaaccggaagccgcccaagugccagagccugauccugaaccccaaguuccucgacaaccaguaccccaacuggcagcaguaccugcaggagcugaagaagcuccaguccauccagaacuaccuggacagcuucgagacggaccugaagguccucaaguccagcaaggaccagcccuacuucguggaguacaaguccagcaaccagcagaucgcguccgggcagcgcgacuacaaggaccuggacgcccggauccugcaguucaucuucgaccgcgugaaggccagcgacgagcuccugcugaacgagaucuacuuccaggccaagaagcucaagcagaaggccuccagcgagcuggagaagcuggaguccagcaagaagcucgacgaggucaucgcgaacucccagcugagccagauccugaagucccagcacaccaacggcaucuucgagcagggcaccuuccuccaccuggugugcaaguacuacaagcagcggcagcgcgcccgcgacagccggcuguacaucaugcccgaguaccgcuacgacaagaagcuccacaaguacaacaacaccgggcgguucgacgacgacaaccagcugcugacguacugcaaccacaagccgcgccagaagcgguaccagcuccugaacgaccuggccggcgugcuccaggucucccccaacuuccugaaggacaagaucgggagcgacgacgaccuguucaucagcaaguggcucguggagcacauccgcggcuucaagaaggccugcgaggacucccugaagauccagaaggacaaccgggggcugcucaaccacaagaucaacaucgcccgcaacaccaagggcaagugcgagaaggagaucuucaaccugaucugcaagaucgagggcagcgaggacaagaaggggaacuacaagcacggccuggcguacgagcucggggugcugcuguucggcgagcccaacgaggccuccaagcccgaguucgaccggaagaucaagaaguucaacagcaucuacuccuucgcccagauccagcagaucgccuucgccgagcgcaaggggaacgcgaacacgugcgccgucugcagcgccgacaacgcccaccggaugcagcagaucaagaucaccgagccgguggaggacaacaaggacaagaucauccucuccgcgaaggcccagcgccugcccgccauccccacccggaucgucgacggcgccgugaagaagauggccaccauccuggcgaagaacaucguggacgacaacuggcagaacaucaagcagguccucagcgccaagcaccagcugcacauccccaucaucaccgaguccaacgccuucgaguucgagccggcccuggccgacgugaagggcaagagccucaaggaccgccggaagaaggcgcuggagcgcaucucccccgagaacaucuucaaggacaagaacaaccggaucaaggaguucgccaaggggaucagcgccuacuccggcgccaaccugaccgacggggacuucgacggcgccaaggaggagcucgaccacaucaucccccgcagccacaagaaguacgggacgcugaacgacgaggcgaaccugaucugcgugacccggggcgacaacaagaacaagggcaaccgcaucuucugccuccgcgaccuggccgacaacuacaagcugaagcaguucgagaccaccgacgaccucgagaucgagaagaagaucgccgacacgaucugggacgccaacaagaaggacuucaaguucgggaacuaccgguccuucaucaaccugacgccccaggagcagaaggcguuccgccacgcccuguuccucgccgacgagaacccgaucaagcaggccgucauccgggccaucaacaaccgcaaccggaccuucgugaacggcacccagcgcuacuucgcggaggugcuggccaacaacaucuaccugcgggccaagaaggagaaccucaacaccgacaagaucagcuucgacuacuucgggauccccaccaucggcaacggccgcgggaucgccgagauccggcagcuguacgagaaggucgacuccgacauccaggccuacgcgaagggcgacaagccccaggccagcuacagccaccugaucgacgccaugcucgccuucugcaucgccgcggacgagcaccgcaacgacggguccaucggccuggagaucgacaagaacuacagccuguacccccucgacaagaacaccggggagguguucaccaaggacaucuucucccagaucaagaucaccgacaacgaguucagcgacaagaagcuggugcggaagaaggccaucgagggcuucaacacgcaccgccagaugacccgggacggcaucuacgccgagaacuaccugccgauccucauccacaaggagcugaacgagguccgcaagggguacaccuggaagaacuccgaggagaucaagaucuucaagggcaagaaguacgacauccagcagcugaacaaccucguguacugccugaaguucguggacaagcccaucagcaucgacauccagaucuccacccuggaggagcuccggaacauccugacgaccaacaacaucgccgcgaccgccgaguacuacuacaucaaccugaagacccagaagcuccacgaguacuacaucgagaacuacaacacggcccugggguacaagaaguacagcaaggagauggaguuccugcgcucccucgccuaccggagcgagcgcgucaagaucaaguccaucgacgacgugaagcagguccuggacaaggacagcaacuucaucaucggcaagaucacccugcccuucaagaaggaguggcagcggcucuaccgcgaguggcagaacaccaccaucaaggacgacuacgaguuccugaaguccuucuucaacgucaagagcaucacgaagcugcacaagaaggugcggaaggacuucucccucccgaucagcaccaacgaggggaaguuccuggugaagcgcaagaccugggacaacaacuucaucuaccagauccugaacgacuccgacagccgcgccgacggcaccaagcccuucauccccgcguucgacaucuccaagaacgagaucguggaggccaucaucgacagcuucacgagcaagaacaucuucuggcuccccaagaacaucgagcugcagaagguggacaacaagaacaucuucgccaucgacaccuccaagugguucgagguggagaccccgagcgaccugcgggacaucggcaucgccaccauccaguacaagaucgacaacaacucccgccccaagguccgggugaagcuggacuacgugaucgacgacgacagcaagaucaacuacuucaugaaccacucccuccucaagagccgcuaccccgacaagguccuggagauccugaagcaguccacgaucaucgaguucgagagcuccggguucaacaagaccaucaaggagaugcugggcaugaagcuggccgggaucuacaacgagaccagcaacaacuga

SEQ ID NO: 1382 - RNA, 3162 nt, Artificial Sequence
  Cas9 variant
augaagcgcaacuacauccugggccucgacaucgggaucaccagcgugggcuacgggaucaucgacuacgagacccgggacgugaucgacgccggcgugcgccuguucaaggaggccaacguggagaacaacgaggggcggcgcuccaagcggggcgcgcgccggcugaagcgccggcgccggcaccgcauccagcgggucaagaagcuccuguucgacuacaaccugcucacggaccacagcgagcuguccggcaucaaccccuacgaggcccgcgugaaggggcugagccagaagcucuccgaggaggaguucagcgccgcccugcugcaccucgccaagcggcgcggcgugcacaacgucaacgagguggaggaggacaccgggaacgagcuguccaccaaggagcagaucagccggaacuccaaggcgcuggaggagaaguacguggccgagcuccagcuggagcgccugaagaaggacggcgagguccgggggagcaucaaccgcuucaagaccuccgacuacgugaaggaggccaagcagcuccugaaggugcagaaggccuaccaccagcuggaccagagcuucaucgacacguacaucgaccuccuggagacccggcgcaccuacuacgagggcccgggcgaggggucccccuucggcuggaaggacaucaaggagugguacgagaugcugauggggcacugcaccuacuuccccgaggagcuccgcagcgucaaguacgcguacaacgccgaccuguacaacgcccugaacgaccucaacaaccuggugaucacgcgggacgagaacgagaagcuggaguacuacgagaaguuccagaucaucgagaacguguucaagcagaagaagaagcccacccucaagcagaucgccaaggagauccuggucaacgaggaggacaucaagggcuaccgcgugaccuccaccggcaagccggaguucacgaaccugaagguguaccacgacaucaaggacaucaccgcccggaaggagaucaucgagaacgcggagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggccaucaaccucauccuggacgagcuguggcacaccaacgacaaccagaucgccaucuucaaccgccucaagcugguccccaagaagguggaccugagccagcagaaggagauccccacgacccucguggacgacuucauccugucccccgucgugaagcggagcuucauccaguccaucaaggugaucaacgccaucaucaagaaguacgggcugccgaacgacaucaucaucgagcuggcgcgcgagaagaacagcaaggacgcccagaagaugaucaacgagaugcagaagcggaaccgccagaccaacgagcggaucgaggagaucauccgcaccacgggcaaggagaacgccaaguaccucaucgagaagaucaagcugcacgacaugcaggaggggaagugccuguacucccucgaggccaucccccuggaggaccugcucaacaaccccuucaacuacgaggucgaccacaucaucccccggagcguguccuucgacaacagcuucaacaacaagguccuggugaagcaggaggagaacuccaagaagggcaaccgcaccccguuccaguaccugagcuccagcgacuccaagaucagcuacgagaccuucaagaagcacauccucaaccuggccaagggcaaggggcggaucuccaagaccaagaaggaguaccugcucgaggagcgcgacaucaaccgguucagcgugcagaaggacuucaucaaccgcaaccuggucgacacgcgguacgcgacccgcggccugaugaaccuccugcgguccuacuuccgcgugaacaaccuggacgugaaggucaagagcaucaacgggggcuucaccuccuuccuccgccggaaguggaaguucaagaaggagcgcaacaagggguacaagcaccacgccgaggacgcccugaucaucgccaacgccgacuucaucuucaaggaguggaagaagcuggacaaggcgaagaaggugauggagaaccagauguucgaggagaagcaggccgagagcaugcccgagaucgagaccgagcaggaguacaaggagaucuucaucacgccccaccagaucaagcacaucaaggacuucaaggacuacaaguacagccaccggguggacaagaagcccaaccgcgagcucaucaacgacacccuguacuccacccggaaggacgacaagggcaacacccugaucgucaacaaccucaacggccuguacgacaaggacaacgacaagcugaagaagcucaucaacaagagcccggagaagcugcugauguaccaccacgacccccagacguaccagaagcucaagcugaucauggagcaguacggggacgagaagaacccccuguacaaguacuacgaggagaccggcaacuaccucaccaaguacuccaagaaggacaacgggcccgugaucaagaagaucaaguacuacggcaacaagcugaacgcccaccuggacaucaccgacgacuacccgaacagccgcaacaagguggucaagcucucccugaagcccuaccgguucgacguguaccuggacaacgggguguacaaguucgucaccgugaagaaccucgacgugaucaagaaggagaacuacuacgaggucaacagcaagugcuacgaggaggccaagaagcugaagaagaucuccaaccaggcggaguucaucgccagcuucuacaacaacgaccugaucaagaucaacggcgagcucuaccgcgugaucggcgugaacaacgaccugcugaaccggaucgaggucaacaugaucgacaucacguaccgcgaguaccucgagaacaugaacgacaagcggccgccccgcaucaucaagaccaucgccuccaagacccagagcaucaagaaguacuccaccgacauccuggggaaccuguacgaggucaagagcaagaagcacccccagaucaucaagaagggcuga

SEQ ID NO: 1383 - RNA, 4230 nt, Artificial Sequence
  Cas9 variant
augcuguucaacaagugcaucaucaucagcaucaaccucgacuucuccaacaaggagaagugcaugaccaagcccuacagcaucggccuggacaucgggaccaacuccgugggcugggccgucaucacggacaacuacaaggugccgagcaagaagaugaaggugcuggggaacaccuccaagaaguacaucaagaagaaccuccugggcguccugcuguucgacagcgggaucaccgccgagggccgccggcugaagcgcaccgcgcggcgccgguacacgcgccggcgcaaccggauccuguaccuccaggagaucuucuccaccgagauggccacccuggacgacgccuucuuccagcgccuggacgacagcuuccucgugcccgacgacaagcgggacuccaaguaccccaucuucggcaaccugguggaggagaaggucuaccacgacgaguuccccaccaucuaccaccuccgcaaguaccucgccgacagcacgaagaaggccgaccugcggcugguguaccucgcgcuggcccacaugaucaaguaccgcgggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccggauccugaagcuguucccgggggagaagaacagcggcaucuucuccgaguuccugaagcugaucgucgggaaccaggccgacuuccgcaagugcuucaaccucgacgagaaggcgagccugcacuucuccaaggagagcuacgacgaggaccuggagacccuccugggcuacaucggcgacgacuacagcgacguguuccugaaggccaagaagcucuacgacgccauccugcuguccggguuccucaccgugacggacaacgagaccgaggcgccccugagcuccgccaugaucaagcgguacaacgagcacaaggaggaccuggcccuccugaaggaguacauccgcaacaucagccugaagaccuacaacgaggucuucaaggacgacaccaagaacggcuacgccggguacaucgacggcaagacgaaccaggaggacuucuacguguaccucaagaaccugcuggccgaguucgagggcgccgacuacuuccucgagaagaucgaccgggaggacuuccugcgcaagcagcggaccuucgacaacggguccauccccuaccagauccaccuccaggagaugcgcgccauccuggacaagcaggcgaaguucuaccccuuccucgccaagaacaaggagcgcaucgagaagauccugaccuuccggaucccguacuacgugggcccccuggcccgcgggaacagcgacuucgccugguccauccggaagcgcaacgagaagaucacccccuggaacuucgaggacgucaucgacaaggagagcuccgccgaggcguucaucaaccggaugacgagcuucgaccucuaccugcccgaggagaaggugcugccgaagcacucccuccuguacgagaccuucaacguguacaacgagcugaccaagguccgcuucaucgccgagagcaugcgggacuaccaguuccucgacuccaagcagaagaaggacaucgugcgccuguacuucaaggacaagcggaaggugaccgacaaggacaucaucgaguaccugcacgccaucuacggcuacgacgggaucgagcucaagggcaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgcgagaugaucaagcagcggcucuccaaguucgagaacaucuucgacaagagcguccugaagaagcugagccgccggcacuacaccggcugggggaagcucuccgccaagcugaucaacggcauccgcgacgagaaguccgggaacacgauccuggacuaccucaucgacgacggcaucagcaaccggaacuucaugcagcugauccacgacgacgcgcugagcuucaagaagaagauccagaaggcccagaucaucggggacgaggacaagggcaacaucaaggagguggugaagucccuccccggcagccccgccaucaagaaggggauccugcaguccaucaagaucgucgacgagcuggugaaggucaugggcgggcgcaagcccgagagcaucgugguggagauggcccgggagaaccaguacaccaaccagggcaaguccaacagccagcagcgccucaagcggcuggagaagucccugaaggagcucgggagcaagauccugaaggagaacaucccggcgaagcuguccaagaucgacaacaacgcccuccagaacgaccgccuguaccuguacuaccuccagaacggcaaggacauguacaccggcgacgaccuggacaucgaccgccugagcaacuacgacaucgaccacaucaucccccaggccuuccucaaggacaacuccaucgacaacaagguccuggugagcuccgccagcaaccgggggaaguccgacgacuuccccagccuggagguggucaagaagcgcaagaccuucugguaccagcuccucaagagcaagcugaucucccagcggaaguucgacaaccucacgaaggccgagcgcggcgggcugcugcccgaggacaaggcgggcuucauccagcggcagcucguggagacccgccagaucaccaagcacguggcccggcugcuggacgagaaguucaacaacaagaaggacgagaacaaccgcgccguccggaccgugaagaucaucacgcucaagagcacccuggugucccaguuccgcaaggacuucgagcuguacaagguccgggagaucaacgacuuccaccacgcccacgacgccuaccucaacgcggugaucgccagcgcccugcugaagaaguacccgaagcucgagcccgaguucguguacggcgacuaccccaaguacaacuccuuccgcgagcgcaagagcgccaccgagaaggucuacuucuacuccaacaucaugaacaucuucaagaaguccaucagccuggccgacgggcgggugaucgagcggccccugaucgaggugaacgaggagaccggcgagagcgucuggaacaaggaguccgaccucgcgaccgugcgccgggugcugagcuacccgcaggucaacguggugaagaaggucgaggagcagaaccacgggcuggaccgcggcaagcccaaggggcuguucaacgccaaccuguccagcaagcccaagcccaacuccaacgagaaccuggugggcgccaaggaguaccucgacccgaagaaguacggcggguacgccggcaucagcaacuccuucgcggugcuggucaaggggacgaucgagaagggcgccaagaagaagaucaccaacgugcuggaguuccaggggaucagcauccucgaccggaucaacuaccgcaaggacaagcugaacuuccugcucgagaagggcuacaaggacaucgagcugaucaucgagcugcccaaguacagccucuucgagcuguccgacggcagccggcgcaugcuggccuccauccucagcaccaacaacaagcgcggggagauccacaagggcaaccagaucuuccugucccagaaguucgugaagcugcucuaccacgccaagcggaucagcaacaccaucaacgagaaccaccgcaaguacgucgagaaccacaagaaggaguucgaggagcuguucuacuacauccuggaguucaacgagaacuacgugggggccaagaagaacggcaagcuccugaacuccgcguuccagagcuggcagaaccacuccaucgacgagcugugcagcuccuucaucgggcccacgggcagcgagcggaagggccucuucgagcugaccucccgcgggagcgccgccgacuucgaguuccugggcgugaagaucccgcgguaccgcgacuacacccccuccagccuccugaaggacgccacccugauccaccaguccgucacggggcuguacgagacccggaucgaccucgccaagcugggcgagggguga

SEQ ID NO: 1384 - RNA, 3306 nt, Artificial Sequence
  Cas9 variant
augugguacgccagccugauguccgcccaccaccuccgcgugggcaucgacgucgggacccacagcgugggccuggcgacccugcggguggacgaccacgggacgcccaucgagcuccuguccgcccugagccacauccacgacuccggcgucgggaaggagggcaagaaggaccacgacacccgcaagaagcucagcggcaucgcccggcgcgcccggcgccugcugcaccaccggcgcacccagcuccagcagcuggacgaggugcugcgggaccucggguucccgauccccacccccggcgaguuccuggaccugaacgagcagacggaccccuaccgcguguggcggguccgcgcccggcucguggaggagaagcugccggaggagcugcgcgggcccgcgaucuccauggccgugcggcacaucgcccgccaccggggcuggcgcaaccccuacagcaaggucgagucccuccugagccccgccgaggaguccccguucaugaaggcgcugcgggagcgcauccucgccaccaccggggaggugcuggacgacggcaucacccccggccaggccauggcccagguggcccugacgcacaacaucagcaugcgggggcccgagggcauccucgggaagcugcaccaguccgacaacgcgaacgagauccgcaagaucugcgcccgccagggcgucagccccgacgugugcaagcagcugcuccgggccguguucaaggccgacuccccgcgcggcagcgccgucucccggguggcgcccgacccccugcccgggcagggcagcuuccgccgggccccgaagugcgaccccgaguuccagcgcuuccggaucaucuccaucguggccaaccugcgcaucagcgagaccaagggggagaaccggccccucaccgccgacgagcgccggcacgucgugaccuuccugacggaggacagccaggccgaccugaccuggguggacgucgcggagaagcucggcgugcaccgccgggaccugcgcgggaccgccgugcacaccgacgacggcgagcgguccgccgcccggcccccgaucgacgccacggaccggaucaugcgccagaccaagaucagcucccugaagaccuggugggaggaggcggacagcgagcagcggggcgccaugauccgcuaccucuacgaggaccccaccgacuccgagugcgccgagaucaucgccgagcugcccgaggaggaccaggcgaagcuggacagccuccaccuccccgccgggcgcgccgccuacucccgggagagccugacggcccucuccgaccacaugcuggcgaccaccgacgaccugcacgaggcccgcaagcggcuguucggcgucgacgacagcugggccccgcccgccgaggccaucaacgcgcccguggggaaccccuccgucgaccgcacccugaagaucgugggccgguaccugagcgccguggaguccaugugggggacgccggaggucauccacguggagcacgugcgcgacggcuucaccagcgagcggauggccgacgagcgcgacaaggccaaccggcgccgguacaacgacaaccaggaggccaugaagaagauccagcgcgacuacggcaaggagggguacaucucccggggcgacaucguccgccucgacgcgcuggagcugcaggggugcgccugccuguacugcggcaccaccaucggguaccacacgugccagcucgaccacaucgugccccaggccggccccggcagcaacaaccggcgcgggaaccugguggccgucugcgagcggugcaaccgcuccaagagcaacaccccguucgcggugugggcccagaagugcggcaucccccacgugggggucaaggaggccaucggccgggugcgcggcuggcggaagcagacccccaacaccuccagcgaggaccugacgcgccucaagaaggaggugaucgcccgccugcggcgcacccaggaggaccccgagaucgacgagcggagcauggaguccgucgccuggauggcgaacgagcugcaccaccgcaucgccgccgccuacccggagaccaccgugaugguguaccgggggagcaucacggccgcggcccgcaaggccgccggcaucgacucccggaucaaccucaucggggagaagggccgcaaggaccggaucgaccgccggcaccacgccgucgacgcgagcgugguggcccugauggaggccuccgucgccaagacccuggcggagcgcagcucccuccgcggggagcagcgccugaccggcaaggagcagaccuggaagcaguacaccggcagcacggugggggcccgggagcacuucgagauguggcgcggccacaugcugcaccucaccgagcuguucaacgagcggcuggccgaggacaagguguacgucacccagaacauccgccuccggcuguccgacgggaacgcccacaccgugaaccccagcaagcuggugucccaccgccucggcgacgggcugacgguccagcagaucgaccgcgccugcacccccgcgcuguggugcgcccucacccgggagaaggacuucgacgagaagaacggccugcccgcccgcgaggaccgggccauccgcgugcacggccacgagaucaagagcuccgacuacauccagguguucagcaagcggaagaagaccgacuccgaccgcgacgagacgccguucggggccaucgcgguccggggcggguucguggagaucggccccagcauccaccacgcccgcaucuaccggguggaggggaagaagcccgucuacgccaugcugcgcguguucacccacgaccuccugucccagcggcacggcgaccuguucagcgccgugaucccgccccagagcaucuccaugcgcugcgccgagcccaagcuccggaaggcgaucaccaccggcaacgccacguaccuggggugggucguggugggcgacgagcuggagaucaacgucgacagcuucaccaaguacgccaucgggcgcuuccucgaggacuuccccaacaccacccgguggcgcaucugcggcuacgacacgaacuccaagcugacccugaagcccaucgugcucgccgccgaggggcuggagaacccgagcuccgcggugaacgagaucgucgagcugaagggcuggcggguggccaucaacgugcucaccaagguccaccccaccguggugcgccgggacgcccugggccgcccccgguacagcucccgcagcaaccugcccacguccuggaccaucgaguga

SEQ ID NO: 1385 - RNA, 4167 nt, Artificial Sequence
  Cas9 variant
augaccaagcccuacagcaucggccuggacaucgggaccaacuccgugggcugggccgucacgaccgacaacuacaaggugccgagcaagaagaugaaggugcucgggaacaccuccaagaaguacaucaagaagaaccugcugggcguccuccuguucgacagcgggaucaccgccgagggccgccggcugaagcgcacggcgcggcgccgguacacccgccggcgcaaccggauccucuaccugcaggagaucuucuccaccgagauggccacccuggacgacgccuucuuccagcgccucgacgacagcuuccuggugcccgacgacaagcgggacuccaaguaccccaucuucggcaaccugguggaggagaaggccuaccacgacgaguuccccacgaucuaccaccuccgcaaguaccuggccgacagcaccaagaaggcggaccugcggcucgucuaccuggcccuggcccacaugaucaaguaccgcgggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgugaaggacaagaucuccaagcuggagaagaaggaccggauccucaagcuguucccgggggagaagaacagcggcaucuucuccgaguuccugaagcucaucguggggaaccaggcggacuuccgcaagugcuucaaccuggacgagaaggccagccugcacuucuccaaggagagcuacgacgaggaccucgagacccugcugggcuacaucggcgacgacuacuccgacgucuuccucaaggccaagaagcuguacgacgccauccugcucagcggguuccugacggugaccgacaacgagaccgaggccccgcugagcuccgcgaugaucaagcgguacaacgagcacaaggaggaccucgcccugcugaaggaguacauccgcaacaucagccucaagaccuacaacgagguguucaaggacgacacgaagaacggcuacgccggguacaucgacggcaagaccaaccaggaggacuucuacgucuaccugaagaagcugcucgccgaguucgagggcgccgacuacuuccuggagaagaucgaccgggaggacuuccugcgcaagcagcggaccuucgacaacggguccauccccuaccagauccaccuccaggagaugcgcgcgauccuggacaagcaggccaaguucuaccccuuccuggccaagaacaaggagcgcaucgagaagauccugaccuuccggaucccguacuacgugggcccccucgcccgcgggaacagcgacuucgccugguccauccggaagcgcaacgagaagaucacgcccuggaacuucgaggacgugaucgacaaggagagcuccgcggaggccuucaucaaccggaugaccagcuucgaccuguaccugcccgaggagaagguccucccgaagcacucccugcuguacgagaccuucaacguguacaacgagcucaccaaggugcgcuucaucgccgagagcaugcgggacuaccaguuccuggacuccaagcagaagaaggacaucguccgccuguacuucaaggacaagcggaaggugacggacaaggacaucaucgaguaccuccacgccaucuacggcuacgacgggaucgagcugaagggcaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgcgagaugaucaagcagcggcuguccaaguucgagaacaucuucgacaagagcgugcugaagaagcucucccgccggcacuacacgggcugggggaagcugagcgcgaagcugaucaacggcauccgcgacgagaaguccgggaacaccauccucgacuaccugaucgacgacggcaucagcaaccggaacuucaugcagcugauccacgacgacgcccucagcuucaagaagaagauccagaaggcccagaucaucggggacgaggacaagggcaacaucaaggaggucgugaagucccugcccggcagccccgccaucaagaaggggauccugcaguccaucaagaucguggacgagcucgucaaggugaugggcgggcgcaagcccgagagcaucgucguggagauggcgcgggagaaccaguacaccaaccagggcaaguccaacagccagcagcgccugaagcggcuggagaagucccucaaggagcuggggagcaagauccugaaggagaacaucccggccaagcucuccaagaucgacaacaacgcccugcagaacgaccgccuguaccucuacuaccugcagaacggcaaggacauguacaccggcgacgaccuggacaucgaccgccucagcaacuacgacaucgaccacaucaucccccaggccuuccugaaggacaacuccaucgacaacaaggugcuggucagcuccgccagcaaccgggggaaguccgacgacgugcccagccucgagguggucaagaagcgcaagacguucugguaccagcugcucaagagcaagcucaucucccagcggaaguucgacaaccugaccaaggcggagcgcggcgggcugagccccgaggacaaggccggcuucauccagcggcagcucguggagacccgccagaucaccaagcacguggcccggcugcuggacgagaaguucaacaacaagaaggacgagaacaaccgcgccguccggacggugaagaucaucacccucaaguccacccuggugagccaguuccgcaaggacuucgagcuguacaagguccgggagaucaacgacuuccaccacgcccacgacgcguaccucaacgccgugguggccuccgcccugcugaagaaguacccgaagcucgagcccgaguucgucuacggcgacuaccccaaguacaacagcuuccgcgagcggaaguccgccaccgagaagguguacuucuacagcaacaucaugaacaucuucaagaaguccaucagccuggcggacgggcgcgugaucgagcggccccugaucgaggucaacgaggagaccggcgaguccguguggaacaaggagagcgaccucgccacggugcgccggguccuguccuacccccaggugaacguggucaagaagguggaggagcagaaccacgggcuggaccgcggcaagcccaaggggcuguucaacgccaaccugagcuccaagcccaagcccaacagcaacgagaaccuggugggcgccaaggaguaccucgacccgaagaaguacggcggguacgcgggcaucuccaacagcuucaccguccuggugaaggggaccaucgagaagggcgccaagaagaagaucaccaacgugcuggaguuccaggggaucuccauccucgaccggaucaacuaccgcaaggacaagcugaacuuccugcucgagaagggcuacaaggacaucgagcugaucaucgagcugcccaaguacagccucuucgagcugagcgacggcucccggcgcaugcuggccagcauccucuccacgaacaacaagcgcggggagauccacaagggcaaccagaucuuccugagccagaaguucgucaagcugcucuaccacgccaagcggaucuccaacaccaucaacgagaaccaccgcaaguacguggagaaccacaagaaggaguucgaggagcuguucuacuacauccuggaguucaacgagaacuacgugggggccaagaagaacggcaagcuccugaacagcgcguuccaguccuggcagaaccacagcaucgacgagcugugcuccagcuucaucgggcccaccggcuccgagcggaagggccucuucgagcugaccagccgcggguccgccgccgacuucgaguuccugggcgucaagaucccgcgguaccgcgacuacacgcccagcucccuccugaaggacgccacccugauccaccagagcgugaccgggcucuacgagacccggaucgaccuggccaagcugggcgagggguga

SEQ ID NO: 1386 - RNA, 3249 nt, Artificial Sequence
  Cas9 variant
auggccgccuucaagcccaacagcaucaacuacauccugggccucgacaucgggaucgcguccgugggcugggccauggucgagaucgacgaggaggagaaccccauccgccugaucgaccugggggugcggguguucgagcgcgccgagguccccaagaccggcgacagccucgccauggcccggcgccuggcgcgguccgugcgccggcugacccgccggcgcgcccaccggcuccugcgcacgcggcgccugcucaagcgggagggggugcugcaggccgccaacuucgacgagaacggccugaucaagagccuccccaacacccccuggcagcugcgcgcggccgcccuggaccggaagcucaccccgcuggagugguccgccguccugcuccaccugaucaagcaccgcggcuaccugagccagcggaagaacgagggggagaccgccgacaaggagcucggcgcgcugcugaaggggguggccggcaacgcccacgcccuccagacgggggacuuccgcacccccgccgagcuggcgcugaacaaguucgagaaggaguccggccacauccggaaccagcgcagcgacuacucccacaccuucagccgcaaggaccuccaggccgagcugauccuccucuucgagaagcagaaggaguucggcaacccccacguguccgggggccugaaggaggggaucgagacccugcucaugacgcagcggcccgcccugagcggcgacgccguccagaagaugcugggccacugcaccuucgagccggccgagcccaaggcggccaagaacaccuacaccgccgagcgcuucaucuggcucacgaagcugaacaaccugcggauccucgagcagggguccgagcgcccccugaccgacaccgagcgggccacccugauggacgagcccuaccgcaagagcaagcucacguacgcccaggcgcggaagcugcugggccucgaggacaccgccuucuucaaggggcugcgcuacggcaaggacaacgccgaggccuccacccugauggagaugaaggcguaccacgccaucagccgggcccucgagaaggaggggcugaaggacaagaaguccccgcugaaccugagccccgagcuccaggacgagaucggcaccgccuucucccuguucaagacggacgaggacaucaccggccgccugaaggaccggauccagcccgagauccucgaggcccugcugaagcacaucagcuucgacaaguucgugcagaucagccucaaggcgcugcgccggaucgugccccugauggagcaggggaagcgcuacgacgaggccugcgccgagaucuacggcgaccacuacgggaagaagaacaccgaggagaagaucuaccucccgcccauccccgccgacgagauccggaaccccgucgugcugcgcgcccugucccaggcgcggaaggugaucaacggcgucgugcgccgguacgggagcccggcccgcauccacaucgagaccgcccgcgaggugggcaaguccuucaaggaccggaaggagaucgagaagcgccaggaggagaaccggaaggaccgcgagaaggccgccgcgaaguuccgggaguacuuccccaacuucgucggcgagcccaagagcaaggacauccucaagcugcgccuguacgagcagcagcacgggaagugccucuacuccggcaaggagaucaaccuggggcggcugaacgagaagggcuacguggagaucgaccacgcccuccccuucagccgcacgugggacgacuccuucaacaacaaggugcugguccuggggagcgagaaccagaacaagggcaaccagaccccguacgaguacuucaacggcaaggacaacucccgggaguggcaggaguucaaggcccgcguggagaccagccgguucccccgcuccaagaagcagcggauccuccugcagaaguucgacgaggacggguucaaggagcgcaaccugaacgacacccgguacgugaaccgcuuccucugccaguucgucgccgaccggaugcgccugacgggcaaggggaagaagcggguguucgcgagcaacggccagaucaccaaccugcuccgcggcuucugggggcugcggaagguccgcgccgagaacgaccgccaccacgcccuggacgccgugguggucgccugcuccaccguggcgaugcagcagaagaucacccgguucgugcgcuacaaggagaugaacgccuucgacggcaagacgaucgacaaggagaccggggagguccuccaccagaagacccacuucccccagcccugggaguucuucgcccaggaggugaugauccggguguucggcaagccggacgggaagcccgaguucgaggaggccgacacccuggagaagcugcgcacgcuccuggccgagaagcugagcucccggcccgaggcgguccacgaguacgugaccccgcuguucgugagccgcgcccccaaccggaagauguccggccagggccacauggagaccgucaagagcgccaagcgccuggacgaggggguguccgugcugcgggucccccucacccagcugaagcugaaggaccucgagaagauggugaaccgcgagcgggagcccaagcuguacgaggcccugaaggcccgccucgaggcgcacaaggacgacccggccaaggccuucgccgagcccuucuacaaguacgacaaggcgggcaaccggacccagcaggucaaggccgugcgcguggagcagguccagaagacgggggugugggugcggaaccacaacggcaucgccgacaacgccaccauggugcgcgucgacguguucgagaagggggacaaguacuaccuggugcccaucuacagcuggcaggucgccaagggcauccugcccgaccgggcgguggugcagggcaaggacgaggaggacuggcagcucaucgacgacagcuucaacuucaaguucucccugcacccgaacgaccuggucgaggugaucaccaagaaggcccgcauguucggguacuucgccagcugccaccggggcaccgggaacaucaacauccgcauccacgaccucgaccacaagaucggcaagaacgggauccuggagggcaucggcgugaagacggcccuguccuuccagaaguaccagaucgacgagcucgggaaggagauccgccccugccggcugaagaagcgcccgcccguccgguga

SEQ ID NO: 1387 - RNA, 4005 nt, Artificial Sequence
  Cas9 variant
augaagaagcccuacaccaucggccuggacaucgggaccaacagcgugggcugggccguccucacggaccaguacgaccuggugaagcgcaagaugaagaucgccggggacuccgagaagaagcagaucaagaagaacuucuggggcgugcggcuguucgacgaggggcagaccgcggccgaccgccggauggcccgcaccgcccggcgccggaucgagcgccggcgcaaccggaucagcuaccuccagggcaucuucgccgaggagauguccaagaccgacgcgaacuucuucugccgccugagcgacuccuucuacgucgacaacgagaagcggaacagccgccacccguucuucgccacgaucgaggaggagguggaguaccacaagaacuaccccaccaucuaccaccuccgggaggagcuggugaacuccagcgagaaggccgaccugcgccuggucuaccucgcccuggcgcacaucaucaaguaccggggcaacuuccugaucgagggggcccucgacacccagaacaccuccguggacggcaucuacaagcaguucauccagacguacaaccagguguucgccagcgggaucgaggacggcucccugaagaagcuggaggacaacaaggacgucgccaagauccucguggagaaggugacccgcaaggagaagcuggagcggauccugaagcucuaccccggggagaaguccgccggcauguucgcgcaguucaucagccugaucgucggcagcaaggggaacuuccagaagcccuucgaccugaucgagaaguccgacaucgagugcgccaaggacagcuacgaggaggaccucgagucccugcuggcccucaucggcgacgaguacgccgagcuguucguggccgcgaagaacgccuacagcgccgugguccuguccagcaucaucaccguggccgagaccgagacgaacgccaagcucagcgcguccaugaucgagcgcuucgacacccacgaggaggaccugggggagcugaaggccuucaucaagcuccaccucccgaagcacuacgaggagaucuucagcaacaccgagaagcacggcuacgccggcuacaucgacgggaagaccaagcaggccgacuucuacaaguacaugaagaugacgcuggagaacaucgagggcgccgacuacuucaucgcgaagaucgagaaggagaacuuccugcggaagcagcgcaccuucgacaacggggccaucccccaccagcugcaccuggaggagcucgaggccauccugcaccagcaggccaaguacuaccccuuccugaaggagaacuacgacaagaucaagucccucgugaccuuccgcauccccuacuucgucggcccgcuggcgaacgggcagagcgaguucgccuggcugacccggaaggccgacggcgagauccgccccuggaacaucgaggagaagguggacuucggcaaguccgccguggacuucaucgagaagaugacgaacaaggacaccuaccuccccaaggagaacguccugcccaagcacagccugugcuaccagaaguaccucguguacaacgagcugaccaaggugcgguacaucaacgaccaggggaagaccuccuacuucagcggccaggagaaggagcagaucuucaacgaccuguucaagcagaagcgcaaggucaagaagaaggaccucgagcuguuccugcggaacaugucccacguggagagcccgacgaucgaggggcuggaggacuccuucaacagcuccuacagcaccuaccacgaccuccugaaggucggcaucaagcaggagauccuggacaaccccgugaacaccgagaugcucgagaacaucgugaagauccugaccgucuucgaggacaagcgcaugaucaaggagcagcugcagcaguucuccgacgugcucgacggggugguccugaagaagcuggagcggcgccacuacacgggcuggggccggcucagcgccaagcugcugauggggauccgcgacaagcagucccaccucaccauccuggacuaccugaugaacgacgacggccucaaccggaaccugaugcagcugaucaacgacagcaaccucuccuucaagagcaucaucgagaaggagcaggucaccaccgcggacaaggacauccagagcaucguggccgaccuggccgggucccccgccaucaagaagggcauccugcagagccucaagaucguggacgagcugguguccgugaugggguacccgccccagacgaucgucguggagauggcccgcgagaaccagaccaccggcaagggcaagaacaacagccggccccgcuacaagucccuggagaaggcgaucaaggaguucgggagccagauccucaaggagcaccccaccgacaaccaggagcugcggaacaaccgccuguaccucuacuaccugcagaacggcaaggacauguacacggggcaggaccuggacauccacaaccucuccaacuacgacaucgaccacaucgugccccagagcuucaucaccgacaacuccaucgacaaccugguccugaccagcuccgccggcaaccgggagaagggcgacgacgugccgccccucgagaucgugcgcaagcggaaggucuucugggagaagcuguaccaggggaaccugaugagcaagcgcaaguucgacuaccucaccaaggccgagcgcggcgggcugaccgaggccgacaaggcccgguucauccaccgccagcugguggagacgcggcagaucaccaagaacguggcgaacauccuccaccagcgcuucaacuacgagaaggacgaccacggcaacaccaugaagcagguccggaucgugacccugaaguccgcccuggugagccaguuccgcaagcaguuccagcucuacaagguccgggacgugaacgacuaccaccacgcccacgacgccuaccugaacgggguggucgcgaacacgcugcucaagguguacccccagcuggagcccgaguucguguacggcgacuaccaccaguucgacugguucaaggccaacaaggccaccgccaagaagcaguucuacaccaacaucaugcuguucuucgcccagaaggaccgcaucaucgacgagaacggcgagauccucugggacaagaaguaccuggacaccgucaagaaggugauguccuaccggcagaugaacaucgugaagaagacggagauccagaagggggaguucagcaaggcgaccaucaagccgaagggcaacuccagcaagcugaucccccgcaagaccaacugggaccccaugaaguacgggggccucgacagccccaacauggccuacgccgucgugaucgaguacgccaaggggaagaacaagcugguguucgagaagaagaucauccgggucaccaucauggagcgcaaggccuucgagaaggacgagaaggcguuccuggaggagcagggcuaccggcagccgaaggugcucgccaagcugcccaaguacacgcuguacgagugcgaggagggccgccggcgcaugcucgccuccgccaacgaggcccagaaggggaaccagcagguccugcccaaccaccuggugacccuccugcaccacgcggccaacugcgaggugagcgacggcaagucccuggacuacaucgagagcaaccgggagauguucgccgagcuccuggcccacguguccgaguucgcgaagcgcuacacccuggccgaggccaaccucaacaagaucaaccagcuguucgagcagaacaaggagggggacaucaaggccaucgcccagagcuucgucgaccugauggcguucaacgccaugggcgccccggccuccuucaaguucuucgagaccacgaucgagcggaagcgcuacaacaaccucaaggagcugcugaacagcaccaucaucuaccaguccaucaccgggcucuacgagagccggaagcgccuggacgacuga

SEQ ID NO: 1388 - RNA, 4038 nt, Artificial Sequence
  Cas9 variant
augaagaagcccuacagcaucggccuggacaucgggaccaacuccgugggcugggccgucgugaccgacgacuacaaggugccggccaagaagaugaagguccucgggaacacggacaagagccacaucgagaagaaccugcugggcgcgcuccuguucgacuccgggaacaccgccgaggaccgccggcugaagcgcaccgcccggcgccgguacacccgccggcgcaaccggauccucuaccugcaggagaucuucagcgaggagaugggcaagguggacgacuccuucuuccaccgccuggaggacagcuuccucgugacggaggacaagcggggcgagcgccaccccaucuucgggaaccuggaggaggaggucaaguaccacgagaacuuccccaccaucuaccaccuccggcaguaccuggccgacaaccccgagaagguggaccugcgccugguguaccucgcccuggcgcacaucaucaaguuccggggccacuuccugaucgaggggaaguucgacacccgcaacaacgacguccagcgccucuuccaggaguuccuggccguguacgacaacaccuucgagaacuccagccugcaggagcagaacgugcaggucgaggagauccucacggacaagaucuccaagagcgccaagaaggaccgggugcugaagcuguucccgaacgagaaguccaacggccgguucgccgaguuccucaagcugaucguggggaaccaggcggacuucaagaagcacuucgagcuggaggagaaggccccgcuccaguucagcaaggacaccuacgaggaggagcuggagguccugcucgcccagaucggcgacaacuacgccgagcuguuccuguccgccaagaagcucuacgacagcauccugcuguccggcauccucaccgugaccgacguggggacgaaggcgccccugagcgccuccaugauccagcgcuacaacgagcaccagauggaccuggcccagcucaagcaguucauccggcagaagcugagcgacaaguacaacgaggucuucuccgacgugagcaaggacggcuacgccggguacaucgacggcaagaccaaccaggaggccuucuacaaguaccugaagggccuccugaacaagaucgaggggagcggcuacuuccuggacaagaucgagcgcgaggacuuccuccgcaagcagcggaccuucgacaacggguccaucccccaccagauccaccuccaggagaugcgcgcgaucauccggcgccaggccgaguucuaccccuuccuggccgacaaccaggaccggaucgagaagcugcugaccuuccgcauccccuacuacgugggcccccuggcccggggcaagagcgacuucgccuggcugucccgcaagagcgcggacaagaucacgcccuggaacuucgacgagaucgucgacaaggaguccagcgccgaggccuucaucaaccggaugaccaacuacgaccucuaccugccgaaccagaaggugcugcccaagcacucccuccuguacgagaaguucaccguguacaacgagcugaccaaggucaaguacaagacggagcaggggaagaccgccuucuucgacgccaacaugaagcaggagaucuucgacggcguguucaaggucuaccgcaaggugaccaaggacaagcucauggacuuccuggagaaggaguucgacgaguuccggaucguggaccugaccgggcucgacaaggagaacaaggucuucaacgcgagcuacggcacguaccacgaccugugcaagauccuggacaaggacuuccucgacaacuccaagaacgagaagauccuggaggacaucgugcugacccucacccuguucgaggaccgcgagaugauccggaagcgccuggagaacuacagcgaccuccugaccaaggagcaggucaagaagcuggagcggcgccacuacacgggguggggccggcucuccgccgagcugauccacgggauccgcaacaaggagagccggaagaccauccuggacuaccucaucgacgacggcaacuccaaccgcaacuucaugcagcugaucaacgacgacgcccugagcuucaaggaggagaucgccaaggcccaggugaucggcgagaccgacaaccucaaccaggugguguccgacaucgcggggagccccgccaucaagaagggcauccugcagucccugaagaucgucgacgagcucgugaagaucauggggcaccagcccgagaacaucguggucgagauggcccgcgagaaccaguucaccaaccagggccggcgcaacagccagcagcggcugaaggggcugacggacuccaucaaggaguucggcagccagauccucaaggagcacccgguggagaacagccagcugcagaacgaccgccuguuccucuacuaccugcagaacggccgggacauguacaccggggaggagcuggacaucgacuaccucucccaguacgacaucgaccacaucaucccccaggccuucaucaaggacaacagcaucgacaaccgcgugcugaccuccagcaaggagaaccggggcaaguccgacgacguccccagcaaggacguggugcgcaagaugaaguccuacuggagcaagcugcucuccgcgaagcugaucacccagcggaaguucgacaaccugacgaaggccgagcgcgggggccucaccgacgacgacaaggccggcuucaucaagcggcagcuggucgagacccgccagaucaccaagcacguggcccggauccuggacgagcgcuucaacaccgagacggacgagaacaacaagaagauccgccaggugaagaucgucacccucaagagcaaccugguguccaacuuccggaaggaguucgagcuguacaaggugcgggagaucaacgacuaccaccacgcccacgacgcguaccucaacgccgucaucgggaaggcccugcugggcguguacccccagcucgagccggaguucguguacggggacuacccccacuuccacggccacaaggagaacaaggccaccgccaagaaguucuucuacagcaacaucaugaacuucuucaagaaggacgacguccgcaccgacaagaacggggagaucaucuggaagaaggacgagcacaucuccaacaucaagaaggugcugagcuacccccaggugaacaucgucaagaagguggaggagcagacgggcggcuucuccaaggagagcauccugcccaaggggaacuccgacaagcucaucccgcggaagaccaagaaguucuacugggacaccaagaaguacggcggguucgacagccccaucguggcguacagcauccuggucaucgccgacaucgagaagggcaaguccaagaagcugaagaccgugaaggcccucgugggggucacgaucauggagaagaugaccuucgagcgcgaccccguggccuuccuggagcggaagggcuaccgcaacgugcaggaggagaacaucaucaagcugcccaaguacagccucuucaagcuggagaacggccgcaagcggcugcucgcguccgcccgcgagcugcagaaggggaacgagaucguccugccgaaccaccucggcacccugcuguaccacgccaagaacauccacaagguggacgagcccaagcaccucgacuacguggacaagcacaaggacgaguucaaggagcugcuggacgucgugagcaacuucuccaagaaguacacccucgccgaggggaaccuggagaagaucaaggagcuguacgcccagaacaacggcgaggaccucaaggagcuggcgagcuccuucaucaaccugcucacguucaccgccaucggggcccccgccaccuucaaguucuucgacaagaacaucgaccggaagcgcuacaccagcacgaccgagauccugaacgccacccugauccaccaguccaucaccggccucuacgagacgcggaucgaccugaacaagcugggcggggacuga

SEQ ID NO: 1389 - RNA, 3171 nt, Artificial Sequence
  Cas9 variant
augcagaccaccaaccugagcuacauccucggccuggaccuggggaucgccuccgugggcugggccgucguggagaucaacgagaacgaggaccccaucgggcucaucgacgugggcguccgcaucuucgagcgggcggaggugccgaagacgggggagagccuggcccugucccgccggcucgcccgcagcacccggcgccugauccggcgccgggcccaccgccugcuccuggccaagcgguuccugaagcgcgagggcauccucuccaccaucgaccuggagaagggccugcccaaccaggcgugggagcuccggguggccgggcuggagcgccggcugagcgccaucgaguggggcgccguccuccugcaccugaucaagcaccgcggguaccucuccaagcggaagaacgagagccagaccaacaacaaggagcugggcgcgcugcucuccgggguggcccagaaccaccagcugcugcagagcgacgacuaccgcacgcccgccgagcucgcccugaagaaguucgccaaggaggagggccacauccggaaccagcgcggcgcguacacccacaccuucaaccggcuggaccuccuggccgagcugaaccuccuguucgcccagcagcaccaguucgggaacccccacugcaaggagcacauccagcaguacaugaccgagcugcucauguggcagaagccggcccuguccggcgaggccauccugaagaugcucgggaagugcacgcacgagaagaacgaguucaaggcggccaagcacaccuacagcgccgagcgcuucguguggcugaccaagcugaacaaccuccgcauccuggaggacggcgccgagcgggcccugaacgaggaggagcgccagcuccugaucaaccaccccuacgagaaguccaagcugaccuacgcgcagguccggaagcuccugggccugagcgagcaggccaucuucaagcaccuccgcuacuccaaggagaacgccgagagcgccacguucauggagcucaaggccuggcacgcgauccggaaggcccuggagaaccaggggcugaaggacaccuggcaggaccucgccaagaagcccgaccugcuggacgagaucggcaccgccuucucccucuacaagaccgacgaggacauccagcaguaccugacgaacaaggugcccaacagcgugaucaacgcgcugcucgucucccugaacuucgacaaguucaucgagcugagccucaagagccugcgcaagauccugccgcucauggagcaggggaagcgguacgaccaggccugccgcgagaucuacggccaccacuacggggaggccaaccagaagaccucccagcugcugcccgccauccccgcccaggagauccggaaccccguggugcuccgcacccugagccaggcgcggaaggucaucaacgccaucauccgccaguacggcuccccggcccgggugcacaucgagaccggccgcgagcugggcaagagcuucaaggagcggcgcgagauccagaagcagcaggaggacaaccggacgaagcgcgaguccgccgugcagaaguucaaggagcuguucagcgacuucuccagcgagcccaaguccaaggacauccugaaguuccggcuguacgagcagcagcacgggaagugccucuacagcgggaaggagaucaacauccaccgccugaacgagaagggcuacgucgagaucgaccacgcccugcccuucucccgcaccugggacgacagcuucaacaacaaggugcucgugcuggcguccgagaaccagaacaaggggaaccagacccccuacgaguggcugcagggcaagaucaacagcgagcgguggaagaacuucgucgcccucgugcugggcucccagugcagcgccgccaagaagcagcgccugcucacccaggugaucgacgacaacaaguucaucgaccggaaccugaacgacacgcgcuacaucgcccgguuccuguccaacuacauccaggagaaccuccugcuggucgggaagaacaagaagaacguguucaccccgaacggccagaucaccgcgcuccugcgcagccggugggggcugaucaaggcccgcgagaacaacaaccggcaccacgcccucgacgccaucgucguggcgugcgccacccccuccaugcagcagaagaucacgcgcuucauccgguucaaggaggugcaccccuacaagaucgagaaccgcuacgagauggucgaccaggagagcggcgagaucaucagcccccacuucccggagcccugggccuacuuccggcaggaggugaacauccgcguguucgacaaccaccccgacaccguccugaaggagaugcugcccgaccggccgcaggccaaccaccaguucgugcagccccucuucgugucccgcgcccccacccggaagaugagcgggcagggccacauggagaccaucaaguccgcgaagcgccuggccgagggcaucagcguccugcggaucccccucacgcagcugaagccgaaccugcucgagaacauggugaacaaggagcgcgagcccgcccuguacgccgggcugaaggcccggcucgcggaguucaaccaggaccccgccaaggccuucgccaccccguucuacaagcagggcgggcagcaggucaaggccauccgcguggagcagguccagaaguccggcgugcuggugcgcgagaacaacggcguggcggacaacgccagcaucgugcggaccgacgucuucaucaagaacaacaaguucuuccuggugcccaucuacaccuggcaggucgccaaggggauccuccccaacaaggccaucguggcgcacaagaacgaggacgagugggaggagauggacgagggcgccaaguucaaguucucccuguuccccaacgaccugguggagcucaagacgaagaaggaguacuucuucggguacuacaucggccuggaccgcgccaccgggaacaucagccugaaggagcacgacggcgagaucuccaagggcaaggacgggguguaccgggucggcgugaagcucgcccugagcuucgagaaguaccagguggacgagcuggggaagaaccgccagaucugccggccgcagcagcgccagcccguccgguga

SEQ ID NO: 1390 - RNA, 3249 nt, Artificial Sequence
  Cas9 variant
auggccgccuucaagcccaacccgaucaacuacauccugggccucgacaucgggaucgcgagcgugggcugggccauggucgagaucgacgaggacgagaaccccaucugccugaucgaccugggggugcgcguguucgagcgggccgagguccccaagaccggcgacucccucgccauggcccgccggcuggcgcgcagcgugcggcgccugacccggcgccgggcccaccgccuccugcgggcccgccggcugcucaagcgcgagggggugcugcaggccgcggacuucgacgagaacggccugaucaagucccuccccaacacgccguggcagcugcgggccgccgcccuggaccgcaagcucacgccccuggaguggagcgccguccugcuccaccugaucaagcaccggggcuaccugucccagcgcaagaacgagggggagaccgcggacaaggagcucggcgcccugcugaaggggguggccgacaacgcccacgcccuccagaccggcgacuuccggacccccgcggagcuggcccugaacaaguucgagaaggagagcgggcacauccgcaaccagcggggcgacuacucccacaccuucagccgcaaggaccuccaggccgagcugauccuccuguucgagaagcagaaggaguucggcaacccccacguguccgggggccugaaggaggggaucgagacccugcucaugacccagcgcccggcccugagcggcgacgccguccagaagaugcugggccacugcacguucgagcccgcggagcccaaggccgccaagaacaccuacaccgccgagcgguucaucuggcucaccaagcugaacaaccugcgcauccucgagcagggguccgagcggccccugacggacaccgagcgcgccacccugauggacgagccguaccgcaagagcaagcucaccuacgcgcaggcccggaagcugcugggccucgaggacacggccuucuucaaggggcugcgguacggcaaggacaacgccgaggcguccacccugauggagaugaaggccuaccacgccaucagccgcgcccucgagaaggaggggcugaaggacaagaaguccccgcugaaccugagccccgagcuccaggacgagaucggcaccgccuucucccuguucaagaccgacgaggacaucacgggccggcugaaggaccgcauccagcccgagauccucgaggcgcugcugaagcacaucagcuucgacaaguucgugcagaucucccucaaggcccugcggcgcaucgugccccugauggagcaggggaagcgguacgacgaggccugcgccgagaucuacggcgaccacuacgggaagaagaacaccgaggagaagaucuaccucccgcccauccccgccgacgagauccgcaaccccgucgugcugcgggcgcugagccaggcccgcaaggugaucaacggcgucgugcggcgcuacgggagccccgcccggauccacaucgagaccgcccgcgaggugggcaaguccuucaaggaccgcaaggagaucgagaagcggcaggaggagaaccgcaaggaccgggagaaggccgcggccaaguuccgcgaguacuuccccaacuucgucggcgagcccaagagcaaggacauccucaagcugcggcuguacgagcagcagcacgggaagugccucuacuccggcaaggagaucaaccuggggcgccugaacgagaagggcuacguggagaucgaccacgcccucccguucagccggaccugggacgacuccuucaacaacaaggugcugguccuggggagcgagaaccagaacaagggcaaccagacgcccuacgaguacuucaacggcaaggacaacucccgcgaguggcaggaguucaaggcccggguggagaccagccgcuucccccgguccaagaagcagcgcauccuccugcagaaguucgacgaggacggguucaaggagcggaaccugaacgacacccgcuacgugaaccgguuccucugccaguucgucgcggaccgcaugcggcugaccggcaaggggaagaagcgcguguucgccagcaacggccagaucacgaaccugcuccggggcuucugggggcugcgcaagguccgggccgagaacgaccgccaccacgcccuggacgccgugguggucgcgugcuccaccguggccaugcagcagaagaucacccgcuucgugcgguacaaggagaugaacgccuucgacggcaagaccaucgacaaggagacgggggagguccuccaccagaagacccacuucccccagccgugggaguucuucgcccaggaggugaugauccgcguguucggcaagcccgacgggaagcccgaguucgaggaggccgacaccccggagaagcugcggacccugcucgcggagaagcugagcucccgccccgaggccguccacgaguacgugacgccccuguucgugagccgggcccccaaccgcaagauguccggccagggccacauggagaccgucaagagcgccaagcggcucgacgaggggguguccgugcugcgcgucccgcugacccagcucaagcugaaggaccuggagaagauggugaaccgggagcgcgagcccaagcucuacgaggcccugaaggcgcggcuggaggcccacaaggacgaccccgccaaggccuucgcggagcccuucuacaaguacgacaaggccggcaaccgcacccagcaggucaaggccgugcggguggagcagguccagaagaccggggugugggugcgcaaccacaacggcaucgccgacaacgccacgauggugcgggucgacguguucgagaagggggacaaguacuaccucgugccgaucuacagcuggcaggucgcgaagggcauccugcccgaccgcgccguggugcagggcaaggacgaggaggacuggcagcugaucgacgacuccuucaacuucaaguucagccuccaccccaacgaccuggucgaggugaucaccaagaaggcccggauguucggguacuucgccagcugccaccgcggcaccgggaacaucaacauccggauccacgaccuggaccacaagaucggcaagaacgggauccucgagggcaucggcgugaagaccgcccuguccuuccagaaguaccagaucgacgagcuggggaaggagauccgccccugccgccucaagaagcggccgcccguccgcuga

SEQ ID NO: 1391 - RNA, 3255 nt, Artificial Sequence
  Cas9 variant
augaaguaccacgugggcaucgacgucgggaccuucagcgugggccuggccgccaucgagguggacgacgcggggaugcccaucaagacccucucccuggucagccacauccacgacuccggccuggacccggacgagaucaagagcgccgugacgcgccucgccuccagcgggaucgcccggcgcacccggcgccuguaccggcgcaagcggcgccggcugcagcagcucgacaaguucauccagcgccagggcuggcccgugaucgagcuggaggacuacuccgacccccuguaccccuggaagguccgggccgagcucgcggccagcuacaucgccgacgagaaggagcgcggcgagaagcuguccguggcccugcggcacaucgcgcgccaccggggguggcgcaacccguacgccaaggugagcucccucuaccugcccgacggccccagcgacgccuucaaggccauccgggaggagaucaagcgcgccuccgggcagcccgucccggagaccgcgaccgugggccagauggugacgcugugcgagcucgggacccugaagcugcggggcgagggcgggguccucagcgcccgccugcagcaguccgacuacgcccgggagauccaggagaucugccgcaugcaggagaucggccaggagcuguaccgcaagaucaucgacgugguguucgccgccgagagccccaagggguccgcgagcucccgggucggcaaggacccccuccagcccggcaagaaccgcgcccugaaggccagcgacgccuuccagcgguaccgcaucgccgcgcugaucgggaaccuccgggugcgcguggacggcgagaagcggauccugagcgucgaggagaagaaccugguguucgaccaccucgugaaccugaccccgaagaaggagcccgagugggucaccaucgccgagauccuggggaucgaccgcggccagcucaucgggacggccaccaugaccgacgacggcgagcgggccggcgcccgcccgcccacccacgacacgaaccgguccaucgugaacagccgcaucgcgccccugguggacugguggaagaccgccuccgcccuggagcagcacgccauggucaaggcgcucagcaacgccgagguggacgacuucgacucccccgagggggccaagguccaggccuucuucgccgaccuggacgacgacgugcacgcgaagcuggacagccuccaccuccccgugggccgggccgccuacuccgaggacacccugguccgccucacccggcgcaugcugagcgacgggguggaccuguacacggcccggcuccaggaguucggcaucgagcccuccuggaccccgcccacgccccgcaucggggagcccgugggcaacccggccgucgaccgggugcugaagaccgugagccgcuggcuggaguccgcgaccaagaccuggggcgcccccgagcgcgucaucaucgagcacgugcgggagggguucgugaccgagaagcgcgcccgggagauggacggcgacaugcgccggcgcgccgcccggaacgcgaagcuguuccaggagaugcaggagaagcugaacguccaggggaagcccagccgcgccgaccuguggcgguaccaguccgugcagcgccagaacugccagugcgccuacugcggcagccccaucaccuucuccaacagcgagauggaccacaucgugccgcgggccgggcagggcuccacgaacacccgcgagaaccucgucgcggugugccaccggugcaaccagagcaagggcaacacccccuucgccaucugggccaagaacaccuccaucgagggggugagcgucaaggaggccguggagcgcacgcggcacugggugaccgacaccggcaugcgcagcaccgacuucaagaaguucacgaaggccgucguggagcgguuccagcgcgcgaccauggacgaggagaucgacgcccgguccauggagagcguggccuggauggccaacgagcugcgcucccgggucgcccagcacuucgcgagccacgggaccaccgugcgcguguaccgcggcucccugacggccgaggcccggcgcgccagcggcaucuccgggaagcugaaguucuucgacggcgucggcaagagccggcucgaccgccggcaccacgccaucgacgcggccgugaucgccuucaccuccgacuacguggccgagacccuggcgguccgcagcaaccugaagcagucccaggcccaccggcaggaggcgccccaguggcgcgaguucaccgggaaggacgccgagcaccgggccgccuggcgcguguggugccagaagauggagaagcucagcgcccugcugaccgaggaccuccgggacgaccgcguggucgugauguccaacgugcggcugcgccuggggaacggcagcgcccacaaggagacgaucggcaagcucuccaaggucaagcugagcucccagcugagcgugagcgacaucgacaaggccuccagcgaggcccucuggugcgcgcugacccgggagccgggguucgaccccaaggagggccugcccgccaaccccgagcgccacauccgggugaacgggacccacgucuacgccggcgacaacaucgggcuguucccgguguccgccggcagcaucgcccugcgcggcggguacgcggagcugggcuccagcuuccaccacgcccggguguacaagaucaccuccgggaagaagcccgccuucgccaugcuccgcgucuacacgaucgaccugcugcccuaccgcaaccaggaccucuucagcguggagcugaagccccagaccauguccaugcggcaggccgagaagaagcugcgcgacgcgcucgccaccggcaacgccgaguaccugggguggcugguggucgacgacgagcucgugguggacaccagcaagaucgccacggaccaggucaaggcgguggaggccgagcugggcaccauccggcgcuggcggguggacggcuucuucuccccgagcaagcugcgccuccggccccugcagauguccaaggaggggaucaagaaggagagcgcccccgagcuguccaagaucaucgaccgccccggcuggcucccggccgucaacaagcuguucagcgacgggaacgugaccgucgugcggcgcgacucccugggccgggugcgccucgagagcaccgcccaccuccccgucacguggaaggugcaguga

SEQ ID NO: 1392 - RNA, 2955 nt, Artificial Sequence
  Cas9 variant
auggcccgcauccuggccuucgacaucggcaucagcuccaucgggugggcguucagcgagaacgacgagcucaaggacugcggcgugcggaucuucaccaaggucgagaaccccaagaccggggagucccuggcccugccgcgccggcucgcccgcagcgcccggaagcgccuggcccggcgcaaggcgcggcugaaccaccucaagcaccugaucgccaacgaguucaagcugaacuacgaggacuaccaguccuucgacgagagccucgccaaggccuacaagggcucccugaucagccccuacgagcugcgcuuccgggcgcucaacgagcugcuguccaagcaggacuucgcccgcgugauccuccacaucgccaagcggcgcggguacgacgacaucaagaacagcgacgacaaggagaagggcgccauccugaaggccaucaagcagaacgaggagaagcuggcgaacuaccaguccgugggcgaguaccucuacaaggaguacuuccagaaguucaaggagaacagcaaggaguucacgaacguccggaacaagaaggaguccuacgagcgcugcaucgcccagagcuuccugaaggacgagcugaagcucaucuucaagaagcagcgggaguucggguucuccuucagcaagaaguucgaggaggaggugcuguccguggccuucuacaagcgcgcccugaaggacuucagccaccucgucggcaacugcuccuucuucaccgacgagaagcgggcccccaagaacagcccccuggcguucauguucguggcccugacccgcaucaucaaccuccugaacaaccugaagaacaccgaggggauccucuacacgaaggacgaccugaacgcccugcucaacgaggugcugaagaacggcacccugaccuacaagcagaccaagaagcuccuggggcugagcgacgacuacgaguucaagggcgagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcgcuggccaaguacgaccucaaccagaaccagaucgacagccuguccaagcuggaguucaaggaccaccucaacaucagcuucaaggcccugaagcuggucaccccgcugaugcucgagggcaagaaguacgacgaggccugcaacgagcugaaccugaagguggccaucaacgaggacaagaaggacuuccuccccgcguucaacgagaccuacuacaaggacgaggugacgaaccccgucgugcugcgggccaucaaggaguaccgcaaggugcugaacgcccuccugaagaaguacgggaagguccacaagaucaacaucgagcuggcccgcgaggugggcaagaaccacucccagcgggcgaagaucgagaaggagcagaacgagaacuacaaggccaagaaggacgccgagcucgagugcgagaagcugggccugaagaucaacagcaagaacauccucaagcugcgccuguucaaggagcagaaggaguucugcgccuacuccggggagaagaucaagaucagcgaccuccaggacgagaagaugcuggagaucgaccacaucuaccccuacucccggagcuucgacgacuccuacaugaacaaggugcuggucuucaccaagcagaaccaggagaagcucaaccagaccccguucgaggccuucggcaacgacagcgcgaaguggcagaagaucgaggugcuggccaagaaccugcccaccaagaagcagaagcgcauccucgacaagaacuacaaggacaaggagcagaagaacuucaaggaccggaaccugaacgacacgcgcuacaucgcccggcuggugcucaacuacaccaaggacuaccuggacuuccugccccucuccgacgacgagaacaccaagcugaacgacacccagaaggggagcaagguccacguggaggccaaguccggcaugcugacgagcgcccuccgccacaccuggggguucuccgcgaaggaccggaacaaccaccuccaccacgccaucgacgccgugaucaucgccuacgccaacaacagcaucgucaaggcguucuccgacuucaagaaggagcaggagagcaacagcgccgagcuguacgccaagaagaucuccgagcuggacuacaagaacaagcgcaaguucuucgagcccuucagcggcuuccggcagaaggugcuggacaagaucgacgagaucuucgucuccaagccggagcgcaagaagcccagcggcgcccugcacgaggagaccuuccggaaggaggaggaguucuaccaguccuacgggggcaaggagggggugcucaaggcgcuggagcugggcaagauccgcaaggugaacgggaagaucgucaagaacggcgacauguuccggguggacaucuucaagcacaagaagaccaacaaguucuacgccgugcccaucuacacgauggacuucgcccucaagguccugcccaacaaggccguggcccgcagcaagaagggcgagaucaaggacuggauccugauggacgagaacuacgaguucugcuucucccucuacaaggacagccugauccugauccagaccaaggacaugcaggagccggaguucguguacuacaacgcguucaccuccagcaccgucucccucaucgugagcaagcacgacaacaaguucgagacgcuguccaagaaccagaagauccuguucaagaacgccaacgagaaggaggugaucgccaagagcaucgggauccagaaccucaaggucuucgagaaguacaucguguccgcccugggcgaggugaccaaggccgaguuccggcagcgcgaggacuucaagaaguga

SEQ ID NO: 1393 - RNA, 3366 nt, Artificial Sequence
  Cas9 variant
augagcgaccuggugcucggccuggacaucgggaucggcuccgucggggugggcauccugaacaaggugaccggggagaucauccacaagaacagccgcaucuuccccgccgcccaggcggagaacaaccucguccggcgcaccaaccggcagggccgccggcuggcccgccggaagaagcaccgccgggugcgccugaaccgccucuucgaggaguccggccugaucacggacuucaccaagaucagcaucaaccugaacccguaccagcuccgggugaaggggcugaccgacgagcuguccaacgaggagcuguucaucgcccugaagaacauggucaagcaccggggcaucagcuaccuggacgacgccuccgacgacgggaacagcuccgugggcgacuacgcccagaucgugaaggagaacagcaagcagcucgagaccaagacgcccgggcagauccagcuggagcgcuaccagaccuacggccagcugcggggcgacuucaccgucgagaaggacgggaagaagcaccgccucaucaacguguuccccaccuccgcguaccggagcgaggcccugcgcauccugcagacgcagcaggaguucaacccccagaucaccgacgaguucaucaaccgguaccucgagauccugaccggcaagcgcaaguacuaccacgggccgggcaacgagaagucccggaccgacuacggccgcuaccgcacgagcggggagacccuggacaacaucuucggcauccucaucgggaagugcaccuucuaccccgacgaguuccgggccgccaaggcguccuacaccgcccaggaguucaaccugcugaacgaccucaacaaccugacggugcccaccgagaccaagaagcugagcaaggagcagaagaaccagaucaucaacuacgucaagaacgagaaggccaugggccccgccaagcuguucaaguacaucgccaagcuccuguccugcgacguggcggacaucaagggguaccgcaucgacaagagcggcaaggccgagauccacaccuucgaggccuaccggaagaugaagacgcucgagacccuggacaucgagcagauggaccgcgagacccuggacaagcucgccuacgugcugacccugaacacggagcgggagggcauccaggaggcccucgagcacgaguucgcggacggguccuucagccagaagcaggucgacgagcuggugcaguuccgcaaggccaacagcuccaucuucggcaagggguggcacaacuucagcgugaagcugaugauggagcucaucccggagcuguacgagaccuccgaggagcagaugaccauccugacccggcucggcaagcagaagacgaccagcuccagcaacaagaccaaguacaucgacgagaagcugcugaccgaggagaucuacaaccccgucguggccaaguccgugcgccaggccaucaagaucgucaacgccgcgaucaaggaguacggggacuucgacaacaucgugaucgagauggcccgggagacgaacgaggacgacgagaagaaggccauccagaagauccagaaggccaacaaggacgagaaggacgccgcgaugcucaaggccgccaaccaguacaacggcaaggccgagcugccccacagcguguuccacggccacaagcagcuggcgaccaagauccgccuguggcaccagcagggggagcggugccucuacaccggcaagaccaucuccauccacgaccugaucaacaacagcaaccaguucgaggucgaccacauccugccccucuccaucacguucgacgacagccuggccaacaaggugcuggucuacgccaccgccaaccaggagaaggggcagcgcaccccguaccaggcccucgacuccauggacgacgcguggagcuuccgggagcugaaggccuucgugcgcgaguccaagacccugagcaacaagaagaaggaguaccuccugaccgaggaggacaucuccaaguucgacgugcggaagaaguucaucgagcgcaaccuggucgacacgcgguacgccagccgcguggugcucaacgcccugcaggagcacuuccgggcccacaagaucgacaccaaggucuccguggugcgcggccaguucaccagccagcugcgccggcacugggggaucgagaagacccgcgacacguaccaccaccacgcggucgacgcccucaucaucgccgccagcucccagcugaaccuguggaagaagcagaagaacacccucgugagcuacuccgaggaccagcugcuggacaucgagaccggcgagcucaucagcgacgacgaguacaaggaguccguguucaaggcccccuaccagcacuucgucgacacccucaagagcaaggaguucgaggacuccauccuguucagcuaccagguggacuccaaguucaaccggaagaucagcgacgcgacgaucuacgccacccgccaggccaaggugggcaaggacaaggccgacgagaccuacguccucgggaagaucaaggacaucuacacccaggacggcuacgacgcguucaugaagaucuacaagaaggacaaguccaaguuccugauguaccggcacgacccccagacguucgagaaggugaucgagcccauccuggagaacuacccgaacaagcagaucaacgagaaggggaaggaggugcccugcaaccccuuccucaaguacaaggaggagcacggcuacauccgcaaguacagcaagaagggcaacgggcccgagaucaagucccugaaguacuacgacagcaagcugggcaaccacaucgacaucaccccgaaggacuccaacaacaaggucgugcuccagagcgugucccccuggcgggccgacgucuacuucaacaagaccaccgggaaguacgagauccugggccugaaguacgccgaccuccaguucgagaaggggacgggcaccuacaagaucagccaggagaaguacaacgacaucaagaagaaggagggcguggacagcgacuccgaguucaaguucacccuguacaagaacgaccugcuccuggugaaggacaccgagacgaaggagcagcagcuguuccgcuuccucagccggaccaugcccaagcagaagcacuacgucgagcugaagcccuacgacaagcagaaguucgagggcggggaggcccugaucaaggugcucgggaacguggccaacuccggccagugcaagaaggggcugggcaagagcaacaucuccaucuacaagguccgcaccgacgugcugggcaaccagcacaucaucaagaacgagggggacaagccgaagcucgacuucuga

SEQ ID NO: 1394 - RNA, 2556 nt, Artificial Sequence
  Cas9 variant
augaccaacggcaagauccuggggcucgacaucggcguggccagcgucggggugggcaucaucgaggccaagaccgggaaggugauccacgcgaacucccgccuguucagcgccgccaacgccgagaacaacgccgagcggcgcggcuuccggggcgcgcgccggcugacgcgccggaagaagcaccgcgucaagcgggugcgcgaccucuucgagaaguacgacauccugaccgacuuccggaaccugaaccucaaccccuacgagcugcgcgugaaggggcugaccgagcagcucaccaacgaggagcuguucgccgcccugcggacgaucgccaagcgccggggcaucuccuaccucgacgacgcggaggacgacagcaccggguccagcgacuacgccaaguccaucgacgagaaccgccggcugcucaagagcaugacccccggccagauccagcuggagcgccuggagaaguacgggcagcugcggggcaacuucaccgucuacgacgagaacggcgaggcccaccgccucaucaacguguucuccacgagcgacuacaagaacgaggcccggaagauccuggagacccaguccaacuacaacaagcagaucaccgacgaguucaucgaggacuacaucgagauccugacccagaagcgcaaguacuaccacgggcccggcaacgagaagucccgcacggacuacgggcgguuccgcaccgacggcaccacccucgagaacaucuucggcauccugaucgggaagugcagcuucuaccccgaggaguaccgggccagcaaggcguccuacacggcccaggaguucaacuuccugaacgaccucaacaaccugaaggugcccaccgagaccggcaagcugagcaccgagcagaaggaguaccucgucaacuucgccaagaacuccaagacgcugggggccagcaagcugcucaaggagaucgccaagcugguggacggcgacgugaaggacaucuccggguaccgcgaggacagcaagggcaagccggaccugcacaccuucgagcccuaccggaagcucaaguucaaccugaccaccgucgacaucgacaaccugagccgcgacauccucgacaagcuggcggacauccugacgcucaacaccgagcgggagggcaucgaggacgccaucaaccagaaccugcccgagcaguucaccaaggagcagaucuccgagaucgugcagauccgcaagagccaguccagcgccuucaacaagggguggcacuccuucagcgccaagcugaugaacgagcucauccccgagcuguacgccaccuccgaggagcagaugacgauccugacccggcucgagaaguucaaggcgaccaagaaguccagcaagaacaccaagacgaucgacgagaaggagaucaccgacgagaucuacaacccgguggucgccaagagcgugcgccagaccaucaagaucaucaacgccgccgugaagaaguacggcgacuucgacaagaucgucaucgagaugccccgggacaagaacgccgacgacgagaagaaguucaucgacaagaagaacaaggagaacaagaaggagaaggacgacucccugaagcgcgcggccuaccuguacaacgggaccgacaagcuccccgacgacguguuccacggcaacaagcagcuggccacgaagauccggcugugguaccagcagggggagcgcugccuguacagcggcaagcccauccucauccaggaccuggugcacaacuccaacaacuucgagaucgaccacauccugccgcucagccuguccuucgacgacagccuggccaacaagguccucguguacgcgugggccaaccaggagaaggagcagaagacccccuaccaggugaucgacuccauggacgccgccuggagcuuccgggagaugaaggacuacguccugaagcagaagggcaucgggaagaagaagcgcgaguaccugcucaccaccgagaacaucgacaagaucgaggugaagaagaaguucaucgagcggaaccuggucgacacccgcuacgccucccggguggugcugaacagccuccagacggcgcugaaggagcugggcaaggacaccaaggucagcguggugcgcgggcaguucaccucccagcuccgccggaaguggaagaucgacaagagccgcgagaccuaccaccaccacgccgucgacgcccugaucaucgccgccuccagccagcugaagcucuggcagaagcacgagaaccugauguucgagaacuacggcgagaaccagguggugaacaaggagacgggggagauccuguccaucagcgacgacgaguacaaggaguccgucuuccagccgcccuaccagggcuucgugaacaccaucagcuccaaggcguucgaggacgagauccucuucagcuaccagguggacuccaaguucaaccggaaggucagcgacgccaccaucuacuccacccgcaaggccaagcugggcaaggacaagaaggaggagacguacgugcuggggaaguga

SEQ ID NO: 1395 - RNA, 2598 nt, Artificial Sequence
  Cas9 variant
augcgccacaagaucggccuggacaucgggaucaccagcgugggcugggccgucaucaaccucgacaucccccggaucgaggaccugggggugcgcaucuucgaccgggccgagaacccccagaccggcgagucccuggcgcucccccgccggcuggcccgcagcgcccggcgccggcugcgccggcgcaagcaccggcucgagcgcauccggcgccugcugauccgggaggggauccucacgaaggaggagcuggacaagcuguucgaggagaagcacgagaucgacguguggcagcuccgcgucgaggcccuggaccggaagcugaacaacgacgagcucgcccgcgugcugcugcaccucgcgaagcggcgcggcuucaaguccaaccgcaagagcgagcggaacaacaaggagaacuccaccaugcugaagcacaucgaggagaaccgcgcccugcucagcggcuaccggaccguggccgagaugaucgucaaggaccccaaguucgccuuccacaagcgcaacaagggggagaacuacaccaacacgaucgcgcgggacgaccuggagcgcgagaucaagcugaucuucaccaagcagcgggaguacggcaacaucgugugcaccgagaccuucgagaacgaguacaucaugaucugggccucccagcgccccuucgccagcaagaacgacaucgagaagaaggugggguucugcacguucgagccgaaggagaagcgggcccccaaggccaccuacaccuuccaguccuucgucgcgugggagcacaucaacaagcuccgccugguguaccccaccggcacgcgggggcugaccgacgaggagcgccggcuccuguacaagcaggccuuccacaagaacaagaucaccuaccacgacauccgcacccugcuccaccuccccgacgacacguacuucaagggcaucguguacgaccggggcgccccgcugaagcagagcgagaccauccgcuuccuggagcuggacgccuaccaccagauccggaaggccgucgacaagguguacgggaagggcaaguccagcuccuuccugcccaucgacuucgacaccuucggguacgcgcucacccuguucaaggacgacgccgacauccgcagcuaccugcggaacgaguacgagcagaacggcaagcgcaugcccaaccucgccaacaagguguacgacaacgagcccaucgaggagcugcugaaccucuccuucacgaaguucggccaccugagccugaaggcccuccgcaacauccugccguacauggagcagggggaggucuacuccguggccugcgagcgggcgggcuacaccuucaccgggcccaagaagaagcagaagacccugcuccugcccaacaucccgcccaucgccaaccccguggucaugcgcgcccugacgcaggcccggaagguggugaacgccaucaucaagaaguacggcagccccgucuccauccacaucgagcuggcgcgcgaccucagccagaccuucgacgagcggcgcaagaccaagcgggagcaggacgagaaccgcaagaagaacgagaccgccauccggcagcugauggaguacgggcugacgaucaaccccaccggccacgacaucgugaaguucaagcucuggagcgagcagaacggccgcugcgccuacucccugcagccgaucgagaucgagcggcugcucgagcccggguacguggaggucgaccacgugauccccuacagccgcucccuggacgacagcuacaccaacaagguccuggugcucaccaaggagaaccgggagaagggcaaccgcauccccgccgaguaccugggggugggcacggagcgguggcagcaguucaagaccuucguccugaccaacaagcaguucuccaagaagaagcgcgaccggcuccugcgccugcacuacgacgagaacgaggaggcggaguggaagaaccggaaccucaacgacacccgcuacaucagccgguucuucgccaacuucauccgcgagcaccugaaguucgccgaguccgacgacaagcagaagguguacacggugaacgggcgcgucaccgcccaccuccggagccgcugggacuucaacaagaaccgggaggaguccgaccugcaccacgccguggacgcggccaucguggccugcaccagcccguccgacaucgcccgcgucaccgccuucuaccagcggcgcgagcagugcaaggagagcgcgaagaaggccgagccccacuucccccagcccuggccgcacuucgccgacgagcugcgggcccgccuguccaagaaccccaaggagagcaucaaggcccucaaccugggcaacuacgacgaccagaagcuggagucccuccagcccguguucgugagccggaugccgaagcgcuccgucaccggcgcggcccaccaggagacgcugcggcgcuacaucgggaucgacgagcggagcggcaagauccagaccguggugaagaccaagcuguccgagaucaagcucgacgagaccgggcacuuccccauguacggcaaggagagcgacccgcccgccagcgccuga

SEQ ID NO: 1396 - RNA, 2886 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcccugccgcgccggcucgcccgcagcgcccggaagcgccuggcgcggcgcaaggcccggcugaaccaccucaagcaccugaucgccaacgaguucaagcugaacuacgaggacuaccaguccuucgacgagagccucgccaaggcguacaagggcucccugaucagccccuacgagcugcgcuuccgggcccucaacgagcugcuguccaagcaggacuucgcccgcgucauccuccacaucgccaagcggcgcggguacgacgacaucaagaacaacggcgacgaggagaagggcaagauccugaaggccaucaagcagaacgaggagaagcuggugaacuaccagagcgugggggaguaccucuacaaggaguacuuccagaaguucaaggagaacuccaaggaguucaucaacguccggaacaagaaggagagcuacgagcgcugcaucacgcaguccuuccugaaguacgagcugaagcucaucuuccagaagcagcgggaguucggcuucagcuucuccaagaaguucgaggaggaggugcugagcguggcguucuacaagcgcgcccugaaggacuucucccaccucgucgggaacugcagcuucuucuccgacgagaagcgggcccccaagaacagcccccuggccuucauguucguggcccugacccgcaucaucaaccuccugaacaaccugaagaacaccgagggcauccucuacaccaaggacgaccugaacgcgcugcucaacgaggugcugaagaacgggacgcugaccuacaagcagaccaagaagcuccugggccugagcgacgacuacgaguucaagggcgagaaggggaccuacuucaucgaguucaagaaguacaaggaguucaucaaggcccucggcgagcacaaccugucccaggacgaccugaacgagaucgccaaggacaucacgcucaucaaggacgagaucaagcugaagaaggcccuggccaaguacgaccucaaccagaaccagaucgacagccuguccaagcuggaguucaaggaccaccucaacaucggguucaaggcgcugaagcugaucaccccgcugaugcucgagggcaagaaguacgacgaggccugcaacgagcugaaccugaaggucgccaucaacgaggacaagaaggacuuccuccccgccuucaacgagaccuacuacaaggacgaggugaccaaccccgugguccugcgggccaucaaggaguaccgcaaggugcugaacgcgcuccugaagaaguacggcaaggugcacaagaucaacaucgagcuggcccgcgaggucgggaagaaccacagccagcgggccaagaucgagaaggagcagaacgagaacuacaaggccaagaaggacgcggagcucgagugcgagaagcugggccugaagaucaacuccaagaacauccucaagcugcgccuguucaaggagcagaaggaguucugcgccuacagcggggagaagaucaagcucuccgaccugcaggacgagaagaugcuggagaucgaccacaucuaccccuacagccgguccuucgacgacagcuacaugaacaaggugcucguguucacgaagcagaaccaggagaagcugaacaagaccccguucgaggccuucggcaacgacaacgucaaguggcagaagaucgaggugcuggccaagaaccuccccgagaagaagcagaagcgcauccuggacaagaacuacaaggacaaggagcagaaggacuucaaggaccggaaccugaacgacacccgcuacaucgcccggcucgugcugaacuacaccaaggacuaccuggacuuccucccccuguccgacgacgagaacacgaagcugaaggggagcaagguccacguggaggcgaaguccggcaugcucaccagcgcccugcgccacaccuggggcuucuccaccaaggaccggaacaaccaccuccaccacgccaucgacgccgccaucaucgcguacgccaacaacagcaucgugaaggacuucuccgacuucaagaaggagcaggagagcaacuccgccgagcuguacgccaagaagaucagcgagcuggacuacaagaacaagcgcaaguucuucgagcccuucagcggguuccggcagaagguccuggacaagaucgacgagaucuucguguccaagccggagcgcaagaagcccagcggcgcccuccacgaggagacguuccggaaggaggaggaguucuaccaguccuacgggggcaaggaggggguccugaaggcgcuggagcucggcaagauccgcaaggugaacggcaagaucgugaagaacggggacauguuccgggucgacaucuucaagcacaagaagaccaacaaguucuacgccgugcccaucuacaccauggacuucgcccugaaggugcugcccaacaaggccgucgcgcgcagcaagaagggcgagaucaaggacuggauccucauggacgagaacuacgaguucugcuucucccuguacaaggacagccugauccucauccagaccaaggacaugcaggagccggagcugguguacuucaacgccuucacguccagcaccgugucccugaucgucagcaagcacgacaacaaguucgagacccucuccaagaaccugaagguguucgagaaguacaucgugagcgcccugggggaggucaccaaggccgaguuccggcagcgcgaggacuucaagaacgagcuccgguga

SEQ ID NO: 1397 - RNA, 2955 nt, Artificial Sequence
  Cas9 variant
auggccaagauccuggccuucgacaucggcaucagcuccaucgggugggcguucagcgagaacgacgagcucaaggacugcggcgugcgcaucuucaccaaggccgagaaccccaagaccggggagucccuggcccugccgcggcgcaucgcccggagcgcccgcaagcggcucgcgcgccggaaggcccgccugaaccaccugaagcaccucaucgccaacgaguucaagcugaacuacgaggacuaccaguccuucgacgagauccuggccaaggcguacaagggcagccucaucucccccuacgagcugcgguuccgcgcccugaacgagcuccugagcaagcaggacuucgcccgggucauccugcacaucgccaagcgccggggguacgacgacaucaagaacaacggcgacgaggagaagggcaagauccucaaggccaucaagcagaacgaggagaagcuggcgaacuaccaguccgugggggaguaccuguacaaggaguacuuccagaaguucaaggagaacagcaaggaguucaucaacgugcgcaacaagaaggaguccuacgagcggugcaucgcccagagcuuccucaaggacgagcugaagcugaucuucaagaagcagcgcgaguucggcuucuccuucagcaagaaguucgaggaggagguccucuccguggccuucuacaagcgggcccugaaggacuucagccaccugguggggaacugcuccuucuucacggacgagaagcgcgcccccaagaacagcccccucgcguucauguucgucgcccugacccggaucaucaaccugcucaacaaccugaagaacacccuguacaccaaggacgaccucaacgcccugcugaacgaggugcucaagaacggcacgcugaccuacaagcagaccaagaagcugcucgggcuguccgacgacuacgaguucaagggcgagaagggcaacuacuucaucgaguucaagaaguacaaggaguucaucaaggcccugggggagcacagccucagccaggacgaccugaacgagaucgccaaggacaucacccugaucaaggacgagaucaagcucaagaaggcgcuggccaaguacgaccugaacgagaaccagaucgacaaccucuccaagcuggaguucaaggaccaccugaacaucagcuucaaggcccucaagcugaucacgccgcugaugcuggagggcaagaaguacgacgaggccugcaacgagcucacccugaagguggccaucaacgaggacaagaaggacuuccugcccgcguucaacgagaccuacuacaaggacgaggucaccaaccccguggugcuccgcgccaucaaggaguaccggaagguccugaacgcccugcucaagaaguacgggaaggugcacaagaucaacaucgagcuggcccgcgaggugggcaagaaccacucccagcgcgcgaagaucgagaaggagcagaacgagaacuacaaggccaagaaggacgccgagcuggagugcgagaagcucggccugaagaucaacagcaagaacauccugaagcuccggcuguucaaggagcagaaggaguucugcgucuacuccggggagaagaucaagcugagcgaccuccaggacgagaagaugcuggagaucgaccacaucuaccccuacucccgcagcuucgacgacuccuacaugaacaaggugcugguguucacgaagcagaaccaggagaagcucaaccagaccccguucgaggccuucggcaacgacagcgccaaguggcagaagaucgagguccuggcgaagaaccugcccaccaagaagcagaagcggauccucgacaagaacuacaaggacaaggagcagaaggacuucaaggaccgcaaccugaacgacacccgguacaucgcccgccuggugcucaacuacacgaaggacuaccuggacuuccugccccucuccgacgacgagaacaccaagcugaacgacacccagaaggggagcaaggugcacgucgaggccaaguccggcaugcugaccagcgcccuccggcacacguggggguucuccaccaaggaccgcaacaaccaccuccaccacgccaucgacgcggugaucaucgccuacgccaacaacagcaucgugaaggccuucuccgacuucaagaaggagcaggagagcaacaccgccgagcuguacgcgaagaagaucuccgagcuggacuacaagaacaagcggaaguucuucgagcccuucagcggcuuccgccagaagguccuggacaagaucgacgagaucuucgugagcaagccggagcggaagaagcccuccggcgcccugcacgaggagaccuuccgcaaggaggaggaguucuaccagagcuacgggggcaaggaggggguccucaaggcccuggagcugggcaagauccggaaggugaacgggaagaucgugaagaacggcgacauguuccgcgucgacaucuucaagcacaagaagacgaacaaguucuacgccgugcccaucuacaccauggacuucgcgcucaaggugcugcccaacaaggccgucgcccgguccaagaagggcgagaucaaggacuggauccugauggacgagaacuacgaguucugcuucagccucuacaaggacucccugauccugauccagaccaaggacaugcaggagccggaguucguguacuacaacgccuucaccagcuccacggugagccucaucgucuccaagcacgacaacaaguucgagacccugagcaagaaccagaagauccuguucaagaacgccaacgagaaggaggugaucgcgaaguccaucgggauccagaaccucaagguguucgagaaguacaucgucagcgcccugggcgaggugaccaaggccgaguuccgccagcgggaggaguucaagaacgagcugcgcuga

SEQ ID NO: 1398 - RNA, 2955 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcccugccgcgccggcucgcccgcagcgcccggaagcgccuggcgcggcgcaaggcccggcugaaccgccucaagcaccugaucgccaacgaguucaagcugaacuacgaggacuaccaguccuucgacgagagccucgccaaggcguacaagggcucccugaucagccccuacgagcugcgguuccgcgcccucaacgagcugcuguccaagcaggacuucgcccgggucauccuccacaucgccaagcgccggggguacgacgacaucaagaacagcgacgacaaggagaagggcgccauccugaaggcgaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggccuucuacaagcgggcccugaaggacuucagccaccucgugggcaacugcuccuucuucaccgacgagaagcgcgcgcccaagaacagcccccuggccuucauguucgucgcccugacccggaucaucaaccuccugaacaaccugaagaacaccgaggggauccucuacacgaaggacgaccugaacgcccugcucaacgaguuccugaagaacggcacccugaccuacaagcagaccaagaagcuccuggggcugagcgacgacuacgaguucaagggcgagaagggcacguacuucaucgaguucaagaaguacaaggaguucaucaaggcccucggggagcacaaccugucccaggacgaccugaacgagaucgcgaaggacaucacccucaucaaggacgagaucaagcugaagaaggcccuggccaaguacgaccucaaccagaaccagaucgacagccuguccaagcuggaguucaaggaccaccucaacaucagcuucaaggcccugaagcugaucaccccgcugaugcucgagggcaagaaguacgacgaggccugcaacgagcugaaccugaagguggcgaucaacgaggacaagaaggacuuccuccccgccuucaacgagaccuacuacaaggacgaggugacgaaccccgucgugcugcgcgccaucaaggaguaccgcaaggugcugaacgcccuccugaagaaguacgggaagguccacaagaucaacaucgagcuggcgcgggaggugggcaagaacuacucccagcgcgccaagaucgagaaggagcagaacgagaacuacaaggccaagaaggacgccgagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcuggucuucaccaagcagaaccaggagaagcucaaccagaccccguucgaggcguucggcaacgacagcgccaaguggcagaagaucgaggugcuggccaagaaccugcccaccaagaagcagaagcggauccucgacaagaacuacaaggacaaggagcagaaggacuucaaggaccgcaaccugaacgacacgcgguacaucgcccgccuggugcucaacuacaccaaggacuaccuggacuuccugccccucuccgacgacgagaacaccaagcugaacgacacccacaaggggagcaagguccacguggaggccaaguccggcaugcugacgagcgcgcuccggcacaccuggggguucuccaccaaggaccgcaacaaccaccuccggcacgccaucgacgccgugaucaucgccuacgccaacaacagcaucgucaaggcguucuccgacuucaagaaggagcaggagagcaacagcgccgagcuguacgccaagaagaucuccgagcuggacuacaagaacaagcgcaaguucuucgagcccuucagcggcuuccggcagaaggugcuggacaagaucgacgagaucuucguguccaagccggagcgcaagaagcccagcggcgcccugcacgaggagaccuuccggaaggaggaggaguucuaccaguccuacgggggcaaggaggggguccucaaggcgcuggagcugggcaagauccgcaaggugaacgggaagaucgucaagaacggcgacauguuccggguggacaucuucaagcacaagaagacgaacaaguucuacgccgugcccaucuacaccauggacuucgcccucaagguccugcccaacaaggccguggcccgcagcaagaagggcgagaucaaggacuggauccugauggacgagaacuacgaguucugcuucucccucuacaaggacagccugauccugauccagaccaaggacaugcaggagccggaguucguguacuacaacgcguucaccuccagcacggucucccucaucgugagcaagcacgacaacaaguucgagacccuguccaagaaccagaagauccuguucaagaacgccaacgagaaggaggugaucgccaagagcaucgggauccagaaccucaaggucuucgagaaguacaucguguccgcccugggcgaggugaccaaggccgaguuccggcagcgcgaggacuucaagaaguga

SEQ ID NO: 1399 - RNA, 2955 nt, Artificial Sequence
  Cas9 variant
auggcccgcauccuggccuucgacaucggcaucagcuccaucgggugggcguucagcgagaacgacgagcucaaggacugcggcgugcggaucuucaccaaggucgagaaccccaagaccggggagucccuggcccugccgcgccggcucgcccgcagcgcccggaagcgccuggcccggcgcaaggcgcggcugaaccaccucaagcaccugaucgccaacgaguucaagcugaacuacgaggacuaccaguccuucgacgagagccucgccaaggccuacaagggcucccugaucagccccuacgagcugcgcuuccgggcgcucaacgagcugcuguccaagcaggacuucgcccgcgugauccuccacaucgccaagcggcgcggguacgacgacaucaagaacagcgacgacaaggagaagggcgccauccugaaggccaucaagcagaacgaggagaagcuggcgaacuaccaguccgugggcgaguaccucuacaaggaguacuuccagaaguucaaggagaacagcaaggaguucacgaacguccggaacaagaaggaguccuacgagcgcugcaucgcccagagcuuccugaaggacgagcugaagcucaucuucaagaagcagcgggaguucggguucuccuucagcaagaaguucgaggaggaggugcuguccguggccuucuacaagcgcgcccugaaggacuucagccaccucgucggcaacugcuccuucuucaccgacgagaagcgggcccccaagaacagcccccuggcguucauguucgugacccugacccgcaucaucaaccuccugaacaaccugaagaacacggaggggauccucuacaccaaggacgaccugaacgcccugcucaacgaggugcugaagaacggcacccugaccuacaagcagacgaagaagcuccuggggcugagcgacgacuacgaguucaagggcgagaagggcaccuacuucaucgaguucaagaaguacaaggaguucaucaaggcccucggggagcacaaccugucccaggacgaccugaacgagaucgccaaggacaucacccucaucaaggacgagaucaagcugaagaaggcccuggcgaaguacgaccucaaccagaaccagaucgacagccuguccaagcuggaguucaaggaccaccucaacaucagcuucaaggcccugaagcugaucaccccgcugaugcucgagggcaagaaguacgacgaggccugcaacgagcugaaccugaaggucgccaucaacgaggacaagaaggacuuccuccccgccuucaacgagacguacuacaaggacgaggugaccaaccccgugguccugcgggcgaucaaggaguaccgcaaggugcugaacgcccuccugaagaaguacgggaaggugcacaagaucaacaucgagcuggcccgcgaggucggcaagaaccacucccagcgggccaagaucgagaaggagcagaacgagaacuacaaggcgaagaaggacgccgagcucgagugcgagaagcugggccugaagaucaacagcaagaacauccucaagcugcgccuguucaaggagcagaaggaguucugcgccuacuccggggagaagaucaagaucagcgaccuccaggacgagaagaugcuggagaucgaccacaucuaccccuacucccggagcuucgacgacuccuacaugaacaaggugcugguguucaccaagcagaaccaggagaagcucaacaagaccccguucgaggccuucggcaacgacagcgccaaguggcagaagaucgagguccuggcgaagaaccugcccacgaagaagcagaagcgcauccucgacaagaacuacaaggacaaggagcagaaggacuucaaggaccggaaccugaacgacacccgcuacaucgcccggcuggugcucaacuacaccaaggacuaccuggacuuccugccccucuccgacgacgagaacaccaagcugaacgacacgcagaaggggagcaaggugcacgucgaggccaaguccggcaugcugaccagcgcccuccgccacaccuggggguucuccaccaaggaccggaacaaccaccuccaccacgccaucgacgcggugaucaucgccuacgccaacaacagcaucgugaaggccuucuccgacuucaagaaggagcaggagagcaacagcgccgagcuguacgcgaagaagaucuccgagcuggacuacaagaacaagcgcaaguucuucgagcccuucagcggcuuccggcagaagguccuggacaagaucgacgagaucuucguguccaagccggagcgcaagaagcccagcggcgcccugcacgaggagacguuccggaaggaggaggaguucuaccaguccuacgggggcaaggaggggguccucaaggcccuggagcugggcaagauccgcaaggugaacgggaagaucgugaagaacggcgacauguuccgggucgacaucuucaagcacaagaagaccaacaaguucuacgccgugcccaucuacaccauggacuucgcgcucaaggugcugcccaacaaggccgucgcccgcagcaagaagggcgagaucaaggacuggauccugauggacgagaacuacgaguucugcuucucccucuacaaggacagccugauccugauccagaccaaggacaugcaggagccggaguucguguacuacaacgccuucacguccagcaccgugucccucaucgucagcaagcacgacaacaaguucgagacccuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccggcagcgcgaggacuucaagaaguga

SEQ ID NO: 1400 - RNA, 2955 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcccugccgcgccggcucgcccgcagcgcccggaagcgccuggcgcggcgcaaggcccggcugaaccaccucaagcaccugaucgccaacgaguucaagcugaacuacgaggacuaccaguccuucgacgagagccucgccaaggcguacaagggcucccugaucagccccuacgagcugcgcuuccgggcccucaacgagcugcuguccaagcaggacuucgcccgcgucauccuccacaucgccaagcggcgcggguacgacgacaucaagaacagcgacgacaaggagaagggcgccauccugaaggcgaucaagcagaacgaggagaagcuggccaacuaccaguccgugggcgaguaccucuacaaggaguacuuccagaaguucaaggagaacagcaaggaguucacgaacgugcggaacaagaaggaguccuacgagcgcugcaucgcccagagcuuccugaaggacgagcugaagcucaucuucaagaagcagcgggaguucggguucuccuucagcaagaaguucgaggaggagguccuguccguggccuucuacaagcgcgcccugaaggacuucagccaccucgugggcaacugcuccuucuucaccgacgagaagcgggcgcccaagaacagcccccuggccuucauguucgucgcccugacccgcaucaucaaccuccugaacaaccugaagaacaccgaggggauccucuacacgaaggacgaccugaacgcccugcucaacgaggugcugaagaacggcacccugaccuacaagcagaccaagaagcuccuggggcugagcgacgacuacgaguucaagggcgagaagggcacguacuucaucgaguucaagaaguacaaggaguucaucaaggcccucggggaccacucccugagccaggacgaccugaacgagaucgcgaaggacaucacccucaucaaggacgagaucaagcugaagaaggcccuggccaaguacgaccucaaccagaaccagaucgacucccugagcaagcuggaguucaaggaccaccucaacaucuccuucaaggcccugaagcugaucaccccgcugaugcucgagggcaagaaguacgacgaggccugcaacgagcugaaccugaagguggcgaucaacgaggacaagaaggacuuccuccccgccuucaacgagaccuacuacaaggacgaggucacgaaccccguggugcugcgggccaucaaggaguaccgcaagauccugaacgcccuccugaagaaguacgggaagguccacaagaucaacaucgagcuggcgcgcgaggugggcaagaaccacagccagcgggccaagaucgagaaggagcagaacgagaacuacaaggccaagaaggacgccgagaucgagugcgagaagcucggccugaagaucaacuccaagaacauccugaagcuccgccuguucaaggagcagaaggaguucugcgccuacagcggggagaagaucaagcuguccgaccuccaggacgagaagaugcuggagaucgaccacaucuaccccuacagccgguccuucgacgacagcuacaugaacaaggugcuggucuucaccaagcagaaccaggagaagcucaacaagaccccguucgaggcguucggcaacgacuccaccaaguggcagaagaucgaggugcuggccaagaaccugcccgagaagaagcagaagcgcauccucgacaagaacuacaaggacaaggagcagaaggacuucaaggaccggaaccugaacgacacgcgcuacaucgcccggcuggugcucaacuacaccaaggacuaccuggacuuccugccccucagcgacgacgagaacaccaagcugaacgacacccagaagggguccaagguccacguggaggccaagagcggcaugcugacguccgcccuccgccacaccuggggguucagcgcgaaggaccggaacaaccaccuccaccacgccaucgacgccgccaucaucgccuacgcgaacaacuccaucgugaaggccuucagcgacuucaagaaggagcaggagagcaacuccgucgagcuguacgccaagaagaucagcgagcuggacuacaagaacaagcgcaaguucuucgagcccuucuccggcuuccggcagaaggugcuggacaagaucgacgagaucuucgugagcaagccggagcgcaagaagcccuccggcgcccugcacgaggagaccuuccggaaggaggaggaguucuaccagagcuacgggggcaaggaggggguccucaaggcgcuggagcugggcaagauccgcaaggugaacgggaagaucgucaagaacggcgacauguuccggguggacaucuucaagcacaagaagaccaacaaguucuacgccgugcccaucuacacgauggacuucgcccucaagguccugcccaacaaggccguggcccgcuccaagaagggcgagaucaaggacuggauccugauggacgagaacuacgaguucugcuucagccucuacaaggacucccugauccugauccagaccaaggacaugcaggagccggagcucguguacuucaacgcguucaccagcuccaccgucagccugaucguguccaagcacgacaacaaguucgagacgcugagcaagaaccagaagauccucuucaagaacgccaacgagaaggaggugaucgccaaguccaucgggauccagaaccugaaggucuucgagaaguacaucgugagcgcccugggcgaggugaccaaggccgaguuccggcagcgcgaggacuucaagaaguga

SEQ ID NO: 1401 - RNA, 2955 nt, Artificial Sequence
  Cas9 variant
auggcccgcauccuggccuucgacaucggcaucagcuccaucgggugggcguucagcgagaacgacgagcucaaggacugcggcgugcggaucuucaccaaggucgagaaccccaagaccggggagucccuggcccugccgcgccggcucgcccgcagcgcccggaagcgccuggcccggcgcaaggcgcggcugaaccaccucaagcaccugaucgccaacgaguucaagcugaacuacgaggacuaccaguccuucgacgagagccucgccaaggccuacaagggcucccugaucagccccuacgagcugcgcuuccgggcgcucaacgagcugcuguccaagcaggacuucgcccgcgugauccuccacaucgccaagcggcgcggguacgacgacaucaagaacagcgacgacaaggagaagggcgccauccugaaggccaucaagcagaacgaggagaagcuggcgaacuaccaguccgugggcgaguaccucuacaaggaguacuuccagaaguucaaggagaacagcaaggaguucacgaacguccggaacaagaaggaguccuacgagcgcugcaucgcccagagcuuccugaaggacgagcugaagcucaucuucaagaagcagcgggaguucggguucuccuucagcaagaaguucgaggaggaggugcuguccguggccuucuacaagcgcgcccugaaggacuucagccaccucgucggcaacugcuccuucuucaccgacgagaagcgggcccccaagaacagcccccuggcguucauguucguggcccugacccgcaucaucaaccuccugaacaaccugaagaacaccgaggggauccucuacacgaaggacgaccugaacgcccugcucaacgaggugcugaagaacggcacccugaccuacaagcagaccaagaagcuccuggggcugagcgacgacuacgaguucaagggcgagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcgcuggccaaguacgaccucaaccagaaccagaucgacagccuguccaagcuggaguucaaggaccaccucaacaucagcuucaaggcccugaagcugaucaccccgcugaugcucgagggcaagaaguacgacgaggccugcaacgagcugaaccugaaggucgccaucaacgaggacaagaaggacuuccuccccgcguucaacgagaccuacuacaaggacgaggugacgaaccccgugguccugcgggccaucaaggaguaccgcaaggugcugaacgcccuccugaagaaguacgggaaggugcacaagaucaacaucgagcuggcccgcgaggucggcaagaaccacucccagcgggcgaagaucgagaaggagcagaacgagaacuacaaggccaagaaggacgccgagcucgagugcgagaagcugggccugaagaucaacagcaagaacauccucaagcugcgccuguucaaggagcagaaggaguucugcgccuacuccggggagaagaucaagaucagcgaccuccaggacgagaagaugcuggagaucgaccacaucuaccccuacucccggagcuucgacgacuccuacaugaacaaggugcugguguucaccaagcagaaccaggagaagcucaacaagaccccguucgaggccuucggcaacgacagcgcgaaguggcagaagaucgagguccuggccaagaaccugcccaccaagaagcagaagcgcauccucgacaagaacuacaaggacaaggagcagaaggacuucaaggaccggaaccugaacgacacgcgcuacaucgcccggcuggugcucaacuacaccaaggacuaccuggacuuccugccccucuccgacgacgagaacaccaagcugaacgacacccagaaggggagcaaggugcacgucgaggccaaguccggcaugcugacgagcgcccuccgccacaccuggggguucuccaccaaggaccggaacaaccaccuccaccacgcgaucgacgccgugaucaucgccuacgccaacaacagcaucgugaaggccuucuccgacuucaagaaggagcaggagagcaacagcgcggagcuguacgccaagaagaucuccgagcuggacuacaagaacaagcgcaaguucuucgagcccuucagcggcuuccggcagaagguccuggacaagaucgacgagaucuucguguccaagccggagcgcaagaagcccagcggcgcccugcacgaggagaccuuccggaaggaggaggaguucuaccaguccuacgggggcaaggaggggguccucaaggcccuggagcugggcaagauccgcaaggugaacgggaagaucgugaagaacggcgacauguuccgggucgacaucuucaagcacaagaagacgaacaaguucuacgcggugcccaucuacaccauggacuucgcccucaaggugcugcccaacaaggccgucgcccgcagcaagaagggcgagaucaaggacuggauccugauggacgagaacuacgaguucugcuucucccucuacaaggacagccugauccugauccagaccaaggacaugcaggagccggaguucguguacuacaacgccuucaccuccagcacggugucccucaucgucagcaagcacgacaacaaguucgagacccuguccaagaaccagaagauccuguucaagaacgcgaacgagaaggaggugaucgccaagagcaucgggauccagaaccucaagguguucgagaaguacaucgucuccgcccugggcgaggugaccaaggccgaguuccggcagcgcgaggacuucaagaaguga

SEQ ID NO: 1402 - RNA, 2955 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcccugccgcgccggcucgcccgcagcgcccggaagcgccuggcgcggcgcaaggcccggcugaaccaccucaagcaccugaucgccaacgaguucaagcugaacuacgaggacuaccaguccuucgacgagagccucgccaaggcguacaagggcucccugaucagccccuacgagcugcgcuuccgggcccucaacgagcugcuguccaagcaggacuucgcccgcgucauccuccacaucgccaagcggcgcggguacgacgacaucaagaacagcgacgacaaggagaagggcgccauccugaaggcgaucaagcagaacgaggagaagcuggccaacuaccaguccgugggcgaguaccucuacaaggaguacuuccagaaguucaaggagaacagcaaggaguucacgaacgugcggaacaagaaggaguccuacgagcgcugcaucgcccagagcuuccugaaggacgagcugaagcucaucuucaagaagcagcgggaguucggguucuccuucagcaagaaguucgaggaggagguccuguccguggccuucuacaagcgcgcccugaaggacuucagccaccucgugggcaacugcuccuucuucaccgacgagaagcgggcgcccaagaacagcccccuggccuucauguucgucgcccugacccgcaucaucaaccuccugaacaaccugaagaacaccgaggggauccucuacacgaaggacgaccugaacgcccugcucaacgaggugcugaagaacggcacccugaccuacaagcagaccaagaagcuccuggggcugagcgacgacuacgaguucaagggcgagaagggcacguacuucaucgaguucaagaaguacaaggaguucaucaaggcccucggggaccacucccugagccaggacgaccugaacgagaucgcgaaggacaucacccucaucaaggacgagaucaagcugaagaaggcccuggccaaguacgaccucaaccagaaccagaucgacucccugagcaagcuggaguucaaggaccaccucaacaucuccuucaaggcccugaagcugaucaccccgcugaugcucgagggcaagaaguacgacgaggccugcaacgagcugaaccugaagguggcgaucaacgaggacaagaaggacuuccuccccgccuucaacgagaccuacuacaaggacgaggucacgaaccccguggugcugcgggccaucaaggaguaccgcaagguccugaacgcccuccugaagaaguacgggaaggugcacaagaucaacaucgagcuggcgcgcgaggugggcaagaacuacagccagcgggccaagaucgagaaggagcagaacgagaacuacaaggccaagaaggacgccgagcucgagugcgagaagcugggccugaagaucaacuccaagaacauccucaagcugcgccuguucaaggagcagaaggaguucugcgccuacagcggggagaagaucaagaucuccgaccuccaggacgagaagaugcuggagaucgaccacaucuaccccuacagccgguccuucgacgacuucuacaugaacaagguccugguguucaccaagcagaaccaggagaagcucaaccagaccccguucgaggcguucggcaacgacagcgccaaguggcagaagaucgaggugcuggccaagaaccugcccaccaagaagcagaagcgcauccucgacaagaacuacaaggacaaggagcagaaggacuucaaggaccggaaccugaacgacacgcgcuacaucgcccggcugguccucaacuacaccaaggacuaccuggacuuccugccccucuccgacgacgagaacaccaagcugaacgacacccagaaggggagcaaggugcacguggaggccaaguccggcaugcugacgagcgcgcuccgccacaccuggggguucuccgccaaggaccggaacaaccaccuccaccacgccaucgacgccgucaucaucgccuacgcgaacaacagcaucgugaaggccuucuccgacuucaagaaggagcaggagagcaacagcgccgagcuguacgccaagaagaucuccgagcuggacuacaagaacaagcgcaaguucuucgagcccuucagcggcuuccggcagaaggugcuggacaagaucgacgagaucuucgucuccaagccggagcgcaagaagcccagcggcgcgcugcacgaggagaccuuccggaaggaggaggaguucuaccaguccuacgggggcaaggagggggugcucaaggcccuggagcugggcaagauccgcaaggucaacgggaagaucgugaagaacggcgacauguuccggguggacaucuucaagcacaagaagaccaacaaguucuacgccguccccaucuacacgauggacuucgcccucaaggugcugcccaacaaggccguggcgcgcagcaagaagggcgagaucaaggacuggauccugauggacgagaacuacgaguucugcuucucccucuacaaggacagccugauccugauccagaccaaggacaugcaggagccggaguucgucuacuacaacgccuucaccuccagcaccgugucccucaucgugagcaagcacgacaacaaguucgagacgcuguccaagaaccagaagauccuguucaagaacgccaacgagaaggaggucaucgccaagagcaucgggauccagaaccucaagguguucgagaaguacaucguguccgcccugggcgaggucaccaaggcggaguuccggcagcgcgaggacuucaagaaguga

SEQ ID NO: 1403 - RNA, 2955 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcccugccgcgccggcucgcccgcagcgcccggaagcgccuggcgcggcgcaaggcccggcugaaccaccucaagcaccugaucgccaacgaguucaagcugaacuacgaggacuaccaguccuucgacgagagccucgccaaggcguacaagggcucccugaucagccccuacgagcugcgcuuccgggcccucaacgagcugcuguccaagcaggacuucgcccgcgucauccuccacaucgccaagcggcgcggguacgacgacaucaagaacagcgacgacaaggagaagggcgccauccugaaggcgaucaagcagaacgaggagaagcuggccaacuaccaguccgugggcgaguaccucuacaaggaguacuuccagaaguucaaggagaacagcaaggaguucacgaacgugcggaacaagaaggaguccuacgagcgcugcaucgcccagagcuuccugaaggacgagcugaagcucaucuucaagaagcagcgggaguucggguucuccuucagcaagaaguucgaggaggagguccuguccguggccuucuacaagcgcgcccugaaggacuucagccaccucgugggcaacugcuccuucuucaccgacgagaagcgggcgcccaagaacagcccccuggccuucauguucgucgcccugacccgcaucaucaaccuccugaacaaccugaagaacaccgaggggauccucuacacgaaggacgaccugaacgcccugcucaacgaguuccugaagaacggcacccugaccuacaagcagaccaagaagcuccuggggcugagcgacgacuacgaguucaagggcgagaagggcacguacuucaucgaguucaagaaguacaaggaguucaucaaggcccucggggagcacaaccugucccaggacgaccugaacgagaucgcgaaggacaucacccucaucaaggacgagaucaagcugaagaaggcccuggccaaguacgaccucaaccagaaccagaucgacagccuguccaagcuggaguucaaggaccaccucaacaucagcuucaaggcccugaagcugaucaccccgcugaugcucgagggcaagaaguacgacgaggccugcaacgagcugaaccugaagaucgcgaucaacgaggacaagaaggacuuccuccccgccuucaacgagaccuacuacaaggacgaggugacgaaccccgugguccugcgggccaucaaggaguaccgcaaggugcugaacgcccuccugaagaaguacgggaaggugcacaagaucaacaucgagcuggcgcgcgaggucggcaagaaccacucccagcgggccaagaucgagaaggagcagaacgagaacuacaaggccaagaaggacgccgagcucgagugcgagaagcugggccugaagaucaacagcaagaacauccucaagcugcgccuguucaaggagcagaaggaguucugcgccuacuccggggagaagaucaagaucagcgaccuccaggacgagaagaugcuggagaucgaccacaucuaccccuacucccggagcuucgacgacuccuacaugaacaaggugcugguguucaccaagcagaaccaggagaagcucaaccagaccccguucgaggcguucggcaacgacagcgccaaguggcagaagaucgagguccuggccaagaaccugcccaccaagaagcagaagcgcauccucgacaagaacuacaaggacaaggagcagaagaacuucaaggaccggaaccugaacgacacgcgcuacaucgcccggcuggugcucaacuacaccaaggacuaccuggacuuccugccccucuccgacgacgagaacaccaagcugaacgacacccagaaggggagcaaggugcacgucgaggccaaguccggcaugcugacgagcgcgcuccgccacaccuggggguucuccgccaaggaccggaacaaccaccuccaccacgccaucgacgccgugaucaucgccuacgcgaacaacagcaucgugaaggccuucuccgacuucaagaaggagcaggagagcaacagcgccgagcuguacgccaagaagaucuccgagcuggacuacaagaacaagcgcaaguucuucgagcccuucagcggcuuccggcagaagguccuggacaagaucgacgagaucuucguguccaagccggagcgcaagaagcccagcggcgcgcugcacgaggagaccuuccggaaggaggaggaguucuaccaguccuacgggggcaaggagggggugcucaaggcccuggagcugggcaagauccgcaaggucaacgggaagaucgugaagaacggcgacauguuccgggucgacaucuucaagcacaagaagaccaacaaguucuacgccgugcccaucuacacgauggacuucgcccucaaggugcugcccaacaaggccgucgcgcgcagcaagaagggcgagaucaaggacuggauccugauggacgagaacuacgaguucugcuucucccucuacaaggacagccugauccugauccagaccaaggacaugcaggagccggaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcccugggcgaggugaccaaggcggaguuccggcagcgcgaggacuucaagaaguga

SEQ ID NO: 1404 - RNA, 2955 nt, Artificial Sequence
  Cas9 variant
auggugcgcauccuggccuucgacaucggcaucagcuccaucgggugggccuucagcgagaacgacgagcucaaggacugcggcguccggaucuucaccaagguggagaaccccaagaccggggagucccuggcgcugccgcgccggcucgcccgcagcgcccggaagcgccuggcccggcgcaaggcccggcugaaccaccucaagcaccugaucgcgaacgaguucaagcugaacuacgaggacuaccaguccuucgacgagagccucgccaaggccuacaagggcucccugaucagccccuacgagcugcgcuuccgggcccucaacgagcugcuguccaagcaggacuucgcgcgcgugauccuccacaucgccaagcggcgcggguacgacgacaucaagaacagcgacgacaaggagaagggcgccauccugaaggccaucaagcagaacgaggagaagcuggccaacuaccaguccgucggcgaguaccucuacaaggaguacuuccagaaguucaaggagaacagcaaggaguucacgaacgugcggaacaagaaggaguccuacgagcgcugcaucgcgcagagcuuccugaaggacgagcugaagcucaucuucaagaagcagcgggaguucggguucuccuucagcaagaaguucgaggaggaggugcuguccgucgccuucuacaagcgcgcccugaaggacuucagccaccucgugggcaacugcuccuucuucaccgacgagaagcgggcccccaagaacagcccccuggccuucauguucguggcgcugacccgcaucaucaaccuccugaacaaccugaagaacaccgaggggauccucuacacgaaggacgaccugaacgcccugcucaacgagguccugaagaacggcacccugaccuacaagcagaccaagaagcuccuggggcugagcgacgacuacgaguucaagggcgagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggcgaaguacgaccucaaccagaaccagaucgacagccuguccaagcuggaguucaaggaccaccucaacaucagcuucaaggcccugaagcugaucaccccgcugaugcucgagggcaagaaguacgacgaggccugcaacgagcugaaccugaagguggccaucaacgaggacaagaaggacuuccuccccgccuucaacgagaccuacuacaaggacgaggugacgaaccccgucgugcugcgggcgaucaaggaguaccgcaaggugcugaacgcccuccugaagaaguacgggaagguccacaagaucaacaucgagcuggcccgcgaggugggcaagaaccacucccagcgggccaagaucgagaaggagcagaacgagaacuacaaggcgaagaaggacgccgagcucgagugcgagaagcugggccugaagaucaacagcaagaacauccucaagcugcgccuguucaaggagcagaaggaguucugcgccuacuccggggagaagaucaagaucagcgaccuccaggacgagaagaugcuggagaucgaccacaucuaccccuacucccggagcuucgacgacuccuacaugaacaaggugcuggucuucaccaagcagaaccaggagaagcucaacaagaccccguucgaggccuucggcaacgacagcgccaaguggcagaagaucgaggugcuggcgaagaaccugcccaccaagaagcagaagcgcauccucgacaagaacuacaaggacaaggagcagaaggacuucaaggaccggaaccugaacgacacgcgcuacaucgcccggcuggugcucaacuacaccaaggacuaccuggacuuccugccccucuccgacgacgagaacaccaagcugaacgacacccagaaggggagcaagguccacguggaggccaaguccggcaugcugacgagcgcccuccgccacaccuggggguucuccaccaaggaccggaacaaccaccuccaccacgccaucgacgcggugaucaucgccuacgccaacaacagcaucgucaaggccuucuccgacuucaagaaggagcaggagagcaacagcgccgagcuguacgcgaagaagaucuccgagcuggacuacaagaacaagcgcaaguucuucgagcccuucagcggcuuccggcagaaggugcuggacaagaucgacgagaucuucgucuccaagccggagcgcaagaagcccagcggcgcccugcacgaggagaccuuccggaaggaggaggaguucuaccaguccuacgggggcaaggagggggugcucaaggcccuggagcugggcaagauccgcaaggugaacgggaagaucgucaagaacggcgacauguuccggguggacaucuucaagcacaagaagacgaacaaguucuacgccgugcccaucuacaccauggacuucgcgcucaagguccugcccaacaaggccguggcccgcagcaagaagggcgagaucaaggacuggauccugauggacgagaacuacgaguucugcuucucccucuacaaggacagccugauccugauccagaccaaggacaugcaggagccggaguucguguacuacaacgccuucaccuccagcacggucucccucaucgugagcaagcacgacaacaaguucgagacccuguccaagaaccagaagauccuguucaagaacgccaacgagaaggaggugaucgccaagagcaucgggauccagaaccucaaggucuucgagaaguacaucguguccgcgcugggcgaggugaccaaggccgaguuccggcagcgcgaggacuucaagaaguga

SEQ ID NO: 1405 - RNA, 2955 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcccugccgcgccggcucgcccgcagcgcccggaagcgccuggcgcggcgcaaggcccggcugaaccaccucaagcaccugaucgccaacgaguucaagcugaacuacgaggacuaccaguccuucgacgagagccucgccaaggcguacaagggcucccugaucagccccuacgagcugcgcuuccgggcccucaacgagcugcuguccaagcaggacuucgcccgcgucauccuccacaucgccaagcggcgcggguacgacgacaucaagaacagcgacgacaaggagaagggcgccauccugaaggcgaucaagcagaacgaggagaagcuggccaacuaccaguccgugggcgaguaccucuacaaggaguacuuccagaaguucaaggagaacagcaaggaguucacgaacgugcggaacaagaaggaguccuacgagcgcugcaucgcccagagcuuccugaaggacgagcugaagcucaucuucaagaagcagcgggaguucggguucuccuucagcaagaaguucgaggaggagguccuguccguggccuucuacaagcgcgcccugaaggacuucagccaccucgugggcaacugcuccuucuucaccgacgagaagcgggcgcccaagaacagcccccuggccuucauguucgucgcccugacccgcaucaucaaccuccugaacaaccugaagaacaccgaggggauccucuacacgaaggacgaccugaacgcccugcucaacgaggugcugaagaacggcacccugaccuacaagcagaccaagaagcuccuggggcugagcgacgacuacgaguucaagggcgagaagggcacguacuucaucgaguucaagaaguacaaggaguucaucaaggcccucggggaccacucccugagccaggacgaccugaacgagaucgcgaaggacaucacccucaucaaggacgagaucaagcugaagaaggcccuggccaaguacgaccucaaccagaaccagaucgacucccugagcaagcuggaguucaaggaccaccucaacaucuccuucaaggcccugaagcugaucaccccgcugaugcucgagggcaagaaguacgacgaggccugcaacgagcugaaccugaagguggcgaucaacgaggacaagaaggacuuccuccccgccuucaacgagaccuacuacaaggacgaggucacgaaccccguggugcugcgggccaucaaggaguaccgcaagguccugaacgcccuccugaagaaguacgggaaggugcacaagaucaacaucgagcuggcgcgcgaggugggcaagaacuacagccagcgggccaagaucgagaaggagcagaacgagaacuacaaggccaagaaggacgccgagcucgagugcgagaagcugggccugaagaucaacuccaagaacauccucaagcugcgccuguucaaggagcagaaggaguucugcgccuacagcggggagaagaucaagaucuccgaccuccaggacgagaagaugcuggagaucgaccacaucuaccccuacagccgguccuucgacgacagcuacaugaacaagguccugguguucaccaagcagaaccaggagaagcucaaccagaccccguucgaggcguucggcaacgacuccgccaaguggcagaagaucgaggugcuggccaagaaccugcccaccaagaagcagaagcgcauccucgacaagaacuacaaggacaaggagcagaaggacuucaaggaccggaaccugaacgacacgcgcuacaucgcccggcugguccucaacuacaccaaggacuaccuggacuuccugccccucagcgacgacgagaacaccaagcugaacgacacccagaagggguccaaggugcacguggaggccaagagcggcaugcugacguccgcgcuccgccacaccuggggguucagcgccaaggaccggaacaaccaccuccaccacgccaucgacgccgucaucaucgccuacgcgaacaacuccaucgugaaggccuucagcgacuucaagaaggagcaggagagcaacuccgccgagcuguacgccaagaagaucagcgagcuggacuacaagaacaagcgcaaguucuucgagcccuucuccggcuuccggcagaaggugcuggacaagaucgacgagaucuucgucagcaagccggagcgcaagaagcccuccggcgcgcugcacgaggagaccuuccggaaggaggaggaguucuaccagagcuacgggggcaaggagggggugcucaaggcccuggagcugggcaagauccgcaaggucaacgggaagaucgugaagaacggcgacauguuccggguggacaucuucaagcacaagaagaccaacaaguucuacgccguccccaucuacacgauggacuucgcccucaaggugcugcccaacaaggccguggcgcgcuccaagaagggcgagaucaaggacuggauccugauggacgagaacuacgaguucugcuucagccucuacaaggacucccugauccugauccagaccaaggacaugcaggagccggaguucgucuacuacaacgccuucaccagcuccaccgugagccucaucguguccaagcacgacaacaaguucgagacgcugagcaagaaccagaagauccuguucaagaacgccaacgagaaggaggucaucgccaaguccaucgggauccagaaccucaagguguucgagaaguacaucgugagcgcccugggcgaggucaccaaggcggaguuccggcagcgcgaggacuucaagaaguga

SEQ ID NO: 1406 - RNA, 2958 nt, Artificial Sequence
  Cas9 variant
auggccaagauccuggccuucgacaucggcaucagcuccaucgggugggcguucguggagaacgacgagcucaaggacugcggcguccgcaucuucaccaaggccgagaaccccaagaccggggagagccuggcccugccgcggcgccucgcccgguccgcccgcaagcggcuggcgcgccggaaggcccgccugaaccaccucaagcaccugaucgccaacgaguucaagcugaacuacgaggacuaccagagcuucgacgagucccucgccaaggcguacaagggcacgcugaucagccccuacgagcugcgguucaaggcccucaacgagcugcuguccaagcaggaccucgcccgcgugauccugcacaucgccaagcggcgcggguacgacaacaucaagaacagcgacgacaaggagaagggcgccauccugaaggcggugaaggagaacgaggagaagcucgccaacuacaaguccgucggcgaguaccuguacaaggaguacuuccagaaguucaaggagaacagcaaggaguucaucaacgugcggaacaagaaggaguccuacgagcgcugcaucgcccagagcuuccugaaggacgagcucaagcugaucuuccagaagcagcgggaguucggguucaacuucuccaagaaguucgaggaggaggugcugagcgucgccuucuacaagcgcgcccucaaggacuucucccaccuggugggcaacugcagcuucuucguggacgagaagcgggcgcccaagaacagcccccuggccuucgaguucgucgcccucacccgcaucgugaaccugcugaacaaccucaacaagaacaacagcuacaucaaggacgaccugaacgcccugcucuccgaggugcugaagaacgggacccugaccuacaagcagacgaagaagauccucggccugagcgacgacuacgaguucaaggggcagaagggcaacuacuucaucgaguucaagaaguacaaggaguucaucaaggcccugugcgagcacaaccucaaccaggacgaccugaacgagaucgcgaaggacaucacccuggucaaggacgagaccaagcucaagaaggcccuggccaaguacgaccugaaccagaaccagaucgagaaccucagcaagaucgaguucaaggaccaccugaacaucuccuucaaggcccugaagcucaucgugccgcugaugcgggagggcaagaaguacgacgaggugugcaacgagcugaaccugaagaccgccaucaacgaggacaagaaggaguuccuccccgcguucaacgagacguacuacaaggacgaggucaacaaccccguggugcugcgcgccaucaaggaguaccggaagguccugaacagccuccugaagaaguacgggaaggugcacaagaucaacaucgagcuggcccgcgaggugggcaagaaccaccgcgagcgguccaagaucgagaaggagcagaacgagaacuucaaggccaagaaggacgcggagcucgagugcgagaagcuggggcugaagaucaacagcaagaacauccucaagcugcgccuguucaaggagcagaaggaguucugcgucuacuccggcgagaagaucaagaucagcgaccuccaggacgagaagaugcuggagaucgaccacaucuaccccuacucccggagcuucgacgacuccuacaugaacaaggugcugguguucaccaagcagaaccaggagaagcucaacaagaccccguucgaggccuucggcaaggacgacgucaaguggcagaagaucgagacccuggccaagaaccugcccgccaagaagcagaagcgcauccucgacaagaacuacaaggacaaggagcagaaggacuucaaggaccggaaccugaacgacacgcgcuacaucgcccggcuggugcucaacuacaccaaggacuaccuggaguuccugccccucagcgacgacgagaacaucaagcugaacgacacccagaagggguccaagguccacguggaggcgaaguccggcaugcugaccuccgugcuccgccacacguggggguucagcaccaaggaccggaacaaccaccuccaccacgccaucgacgccgucaucaucgccuacgccaacgcguccguggugaaggccuucagcgacuucaagaaggagcaggagaacuacaccgccgagcuguacgccaagaagaucaacgagcuggacuucaagaacaagcgcaaguucuucgagcccuucuccaacuuccggcagaagguccuggagaagaucgacgagaucuucgugagcaagccggagcgcaagaagcccuccggcgcccugcacgaggagaccuucuacaaggaggaggaguucuacaaggaguacgggggcaaggagggcgugcucaaggcgcuggagcuggggaagauccggaaggucaacggcaagaucgugagcaacgccaacauguuccgcguggacaucuucaaguacaagaagacgaacaaguucuacgccguccccaucuacaccauggacuucgcccucgggauccugcccaacaaggcgguggugggcgggaaggacaagcagggcaucaucaaggacuggcugcucauggacgagaacuacgaguucugcuucagccuguacaaggacucccugauccuccugcagaccaaggacaugcaggagccggagcuggucuacuucaagagcuucaaguccagcaccgccggccucgugguguccaagcacgacaacaaguucgagaaccugaacgagaaccagaagaagcuguucaagagcgccaacgagaagaaggucguggccgaggggaucggcauccagaaccucaagguguucgagaaguacaucgucuccgcccugggggagaucacgaaggcggagaucaaggagcgggagaacuucaagaagaaguga

SEQ ID NO: 1407 - RNA, 2961 nt, Artificial Sequence
  Cas9 variant
augcccagcgacccggccgaggccaagccccuggagcuccuggaccccuacgcgcugcgcgcccagggccucgaccaggcccugccccugacccacuucgggcgggcccucuuccaccugaaccagcgccggggcuucaaguccaaccgcaagaccgaccgcggggacaacgagaacggcaagaucaaggacgccagccagcggcuggacugggcgaugcacgaggccaaggcccggacguacggggaguuccuccaccuccgccggcagaaggccccggacccccgccaggugcccaccguccggacccgccuguccgugggcaagcggggcgggcccgacgcgaaggaggaggccggcuacgacuucuacccggaccgccggcaccuggaggaggaguuccacgagcuguggagcgcccaggcccaguuccaccccgagcugacccaggaccuccgcgaccugguguucgagaagaucuucuaccagcggccccugaaggagcccaaggucgggcucugccuguucacguccgaggagcgccuggccaaggcgcacccgcucacccagcggcgcgugcuguacgagaccgugaaccagcugcggaucaccgccgacggccgcagcguccgcccccucucccgggagcagcgcgaccagaucauccuggcccuggacacgaagaagcccaccaagagccucaacuccaugguggugacccugcaggcccuggggaagguccucaagcugcgggagggcgagcgcuucacccuggagagcggcgugcgggaggccaucgcgugcgaccccgugcgcgccgccaugcucgccacguucgggccgcggugguccgcccuggacuggcccgagcaguggcaggucaucagccgcgugcggaagcugcaggacgacaaggacuucgcggagcucguggaguggcugaucgagcuguacggcgucgacaaggaggccgccgugaagaucgccaacacccaccuccccgagggguacggccgccugggccugaccgccaccacgcggauccucgaccgccugaaguccaacguguucaccuacgcgcaggccgucgccgccugcggguggcaccacagcgaccagcggaccggcgagugccuggaccgccuccccuacuacggggcggugcuggaccggcacgugaucccgggcaccuacgacgagaacgacgacgacaucacgcgcuucgggcggaucaccaaccccaccguccacaucggccugaaccagcuccgccggcuggugaacaagaucaucgagguguacggcaagcccaaccagaucgucguggagcuggcccgcgagcugaagcaguccgagcagcagaagaacgacgccaucaagcucauccgcgacaccacgaccgccgccaagcagcggagcgagaagcuggaggagcuggggaucaccgacaacggccgcaaccggaugcuccugcgccugugggaggaccucaaccccgacgacgcgaugcggcgcuucugcccguacaccgggcagcggaucuccgccgccaugaucuucgacggcagcugcgacgucgaccacauccugcccuacucccgcacgcuggacgacggguucgccaaccggacccucugccugcgcgaggccaaccgggagaagcgcaaccagacccccugggaggcguggggcggcacccccaacugggaggccaucgagacgaaccugaagaaccucccggagaacaagcgguggcgcuucgcccccgacgccauggcccgguucgagggggagaacgacuuccuggaccgcgcgcugguggacacccaguaccucgcccggaucagccgcaccuaccuggacacccuguucacggagggcgggcacgugugggucgugcccggccggcucaccgagaugcugcgccggcacugggggcugaacagccuccugaccgacaaggaccgcggcgccgugaaguccaagaaccgcaccgaccaccggcaccacagcaucgacgccgcggucguggccgccaccgaccgcucccugcucaaccggaucagccgcgccgccggccagggggagguggcgggccaguccgccgagcugaucgcccgggagacgccgccgcccugggagggguuccgcaacgaccucaagagccagcugggccggaucaucgucucccaccgcgccgaccacggccggaucgaccgccaggcccggaagcaggggcgcgacagcaccgcgggccagcugcaccaggagaccgccuacuccaucguggacgacacccggguggccagccgcaucgacuuccuguccgucaagcccgcccagcuccuggaccagcccgggcggagcggccaggugcgcgaccugcagcuccggaaggcccugcgcguggcgacgggggaccugaccggcaaggacuacgagaaggcccuccgggacuucgccgccaagcccggccccuacaaggggauccgccgcguccggaucaucaagccccugcaggagcaggcgcgcgugccggugcccguccuggaccccaucaaggccuaccagggcggguccaaccacguguucgagaucuggcaccuccccgacggcaagguggagccgcaggucaucaccagcuucgaggcccacgcccuggagguggagaagcggccccaccccgccgcgaagcgccugcuccgggugcacaagggggacauggucgcccugaagcgcgagggccggaccguggugggccacguccagcagaugcacaucaagaacgggcuguucaucgugccccacaacgaggccaacgccgacgcccgcaacuccgaccggacggacccguucaaguggauccagaucgcggcccagcccgccaucgccgccggcauccgccggguggcggucgacgagaucgggcgccuccgggacggcggggccaagaccaucuga

SEQ ID NO: 1408 - RNA, 2964 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcccugccgcgccggcucagccgcuccgcccggaagcgccuggcccggcgcaaggcgcggcugaaccaccucaagcaccugaucgccaacgaguucaagcugaacuacgaggacuaccagagcuucgacgagucccucgccaaggccuacaagggcagccugaucucccccuacgagcugcgcuuccgggcgcucaacgaguuccugagcaagcaggacuucgcccgcgucauccugcacaucgccaagcggcgcggguacgacgacaucaagaacaacggcgacgaggagaagggcgagauccucaaggccaucaagcagaacgaggagaagcugguguccuaccagagcgugggggaguaccuguacaaggaguacuuccagaaguucaaggagaacuccaaggaguucaucaacguccggaacaagaaggagagcuacgagcgcugcaucgcccaguccuuccucaaggacgagcugaagcugaucuuccagaagcagcgggaguucggcuucagcuucuccaagaaguucgaggaggaggugcucagcguggcguucuacaagcgcgcccugaaggacuucucccaccuggucgggaacugcagcuucuucacggacgagaagcgggcccccaagaacagcccccucgccuucauguucguggcccugacccgcaucaucaaccugcucaacaaccugaagaacaccgagggcauccuguacaccaaggacgaccucaacacgcugcugaacgaggugcucaagaacgggacccugaccuacaagcagaccaagaagcugcucggccuguccaacgacuacgaguucaagggcgagaaggggacguacuucaucgaguuccagaaguacaaggaguucgucaaggcgcugggcgagcacaaccucagccaggacgaccugaacgagaucgccaaggacaucacccugaucaaggacgagaucaagcucaagaaggcccuggccaaguacgaccugaaccagaaccagaucgacucccucagcaagcuggaguucaaggaccaccugaacaucuccuucaaggcccucaagcugaucaccccgcugaugcuggaggggaagaaguacgacgaggcgugcaacgagcucaaccugaagguggccaucaacgaggacaagaaggacuuccugcccgccuucaacgagaccuacuacaaggacgaggugacgaaccccgucgugcuccgggccaucaaggaguaccgcaaggugcugaacgcccugcucaagaaguacggcaagguccacaagaucaacaucgagcuggcgcgcgaggugggcaagaaccacagccagcgggccaagaucgagaaggagcagaacgagaacuacaaggccaagaaggacgccgagcuggagugcgagaagcucgggcugaagaucaacuccaagaacauccugaagcuccgccuguucaaggagcagaaggaguucugcguguacagcggcgagaagaucaagaucuccgaccugcaggacgagaagaugcucgagaucgaccacaucuaccccuacagccgguccuucgacgacagcuacaugaacaagguccugguguucaccaagcagaaccaggagaagcugaacaagaccccguucgagaccuucgggaacgaccgcgugaaguggcagaagaucgagguccucgcgaagaaccugcccacgaagaagcagaagcggauccuggacaagaacuacaaggacaaggagcagaaggacuucaaggaccgcaaccucaacgacacccgguacaucgcccgccuggugcugaacuacaccaaggacuaccucgacuuccugccccuguccgacgacgagaacaccaagcucaacgacacgcagaagggcagcaaggugcacgucgaggccaaguccgggaugcugaccagcacccugcggcacaccuggggcuucuccacgaaggaccgcgacaaccaccuccaccacgccaucgacgccgcgaucaucgccuacgccaacaacagcaucgugaaggccuucuccgacuucaagaaggagcaggagagcaacaccgccgagcuguacgcgaagaagaucagcgagcuggacuacaagaacaagcggaaguucuucgagcccuucuccggcuuccgccagaagcuccuggacaagaucgacgagaucuucgucagcaagccggagcggaagaagcccuccggggcccugcacgaggagaccuuccgcaaggaggaggaguucuaccagagcuacggcgggaaggagggcgugcucaaggcccuggagcuggggaagauccggaaggugaacggcaagauggucaagaacggcgacauguuccgcguggacaucuucaagcacaagaagaccaacaaguucuacgccgugcccaucuacacgauggacuucgcccucaagguccugcccaacaaggcgguggugcaggggaaggacaagaaguccggccugaucaaggacuggauccucauggacgagaacuacgaguucugcuucagccuguacaaggacucccugauccucauccagaccaaggacaugcaggagccggagcuggucuacuacgagcggcuggacagcuccaacgccagccucaccguguccaagcacgacaacaaguucgagacccugagcaagaaccagaagauccuguucaagaacgccaacgagaaggaggugaucgccaaguccaucgggauccagaaccucaaggucuucgagaaguacaucgugagcgcgcugggcgaggugacgaaggccgaguuccgccagcgggaggacuucaagaaguga

SEQ ID NO: 1409 - RNA, 2964 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcccugccgcgccggcucgcccgcagcgcccggaagcgccuggcgcggcgcaaggcccggcugaaccaccucaagcaccugaucgccaacgaguucaagcugaacuacgaggacuaccaguccuucgacgagagccucgccaaggcguacaagggcucccugaucagccccuacgagcugcgcuuccgggcccucaacgagcugcuguccaagcaggacuucgcccgcgucauccuccacaucgccaagcggcgcggguacgacgacaucaagaacagcgacgacaaggagaagggcgccauccugaaggcgaucaagcagaacgaggagaagcuggccaacuaccaguccgugggcgaguaccucuacaaggaguacuuccagaaguucaaggagaacagcaaggaguucacgaacgugcggaacaagaaggaguccuacgagcgcugcaucgcccagagcuuccugaaggacgagcugaagcucaucuucaagaagcagcgggaguucggguucuccuucagcaagaaguucgaggaggagguccuguccguggccuucuacaagcgcgcccugaaggacuucagccaccucgugggcaacugcuccuucuucaccgacgagaagcgggcgcccaagaacagcccccuggccuucauguucgucgcccugacccgcaucaucaaccuccugaacaaccugaagaacaccgaggggauccucuacacgaaggacgaccugaacgcccugcucaacgaggugcugaagaacggcacccugaccuacaagcagaccaagaagcuccuggggcugagcgacgacuacgaguucaagggcgagaagggcacguacuucaucgaguucaagaaguacaaggaguucaucaaggcccucggggaccacucccugagccaggacgaccugaacgagaucgcgaaggacaucacccucaucaaggacgagaucaagcugaagaaggcccuggccaaguacgaccucaaccagaaccagaucgacucccugagcaagcuggaguucaaggaccaccucaacaucuccuucaaggcccugaagcugaucaccccgcugaugcucgagggcaagaaguacgacgaggccugcaacgagcugaaccugaagguggcgaucaacgaggacaagaaggacuuccuccccgccuucaacgagaccuacuacaaggacgaggucacgaaccccguggugcugcgggccaucaaggaguaccgcaagguccugaacgcccuccugaagaaguacgggaaggugcacaagaucaacaucgagcuggcgcgcgaggugggcaagaacuacagccagcgggccaagaucgagaaggagcagaacgagaacuacaaggccaagaaggacgccgagcucgagugcgagaagcugggccugaagaucaacuccaagaacauccucaagcugcgccuguucaaggagcagaaggaguucugcgccuacagcggggagaagaucaagaucuccgaccuccaggacgagaagaugcuggagaucgaccacaucuaccccuacagccgguccuucgacgacagcuacaugaacaagguccugguguucaccaagcagaaccaggagaagcucaaccagaccccguucgaggcguucggcaacgacuccgccaaguggcagaagaucgaggugcuggccaagaaccugcccaccaagaagcagaagcgcauccucgacaagaacuacaaggacaaggagcagaaggacuucaaggaccggaaccugaacgacacgcgcuacaucgcccggcugguccucaacuacaccaaggacuaccuggacuuccugccccucagcgacgacgagaacaccaagcugaacgacacccagaagggguccaaggugcacguggaggccaagagcggcaugcugacguccgcgcuccgccacaccuggggguucagcgccaaggaccggaacaaccaccuccaccacgccaucgacgccgucaucaucgccuacgcgaacaacuccaucgugaaggccuucagcgacuucaagaaggagcaggagagcaacuccgccgagcuguacgccaagaagaucagcgagcuggacuacaagaacaagcgcaaguucuucgagcccuucuccggcuuccggcagaaggugcuggacaagaucgacgagaucuucgucagcaagccggagcgcaagaagcccuccggcgcgcugcacgaggagaccuuccggaaggaggaggaguucuaccagagcuacgggggcaaggagggggugcucaaggcccuggagcugggcaagauccgcaaggucaacgggaagaucgugaagaacggcgacauguuccggguggacaucuucaagcacaagaagaccaacaaguucuacgccguccccaucuacacgauggacuucgcccucaaggugcugcccaacaaggccguggcgcgcuccaagaagggcgagaucaaggacuggauccugauggacgagaacuacgaguucugcuucagccucuacaaggacucccugauccugauccagaccaaggacaugcaggagccggagcucgucuacuucaacgccuucaccagcuccaccgugagccugaucguguccaagcacgacaacaaguucgagacgcugagcaagaaccagaagauccucuucaagaacgccaacgagaaggaggucaucgccaaguccaucgggauccagaaccugaagguguucgagaaguacaucgugagcgcccugggcgaggucaccaaggcggaguuccggcagcgcgaggacuucaagaacgagcuccgguga

SEQ ID NO: 1410 - RNA, 2964 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcccugccgcgccggcucgcccgcagcgcccggaagcgccuggcgcggcgcaaggcccggcugaaccaccucaagcaccugaucgccaacgaguucaagcugaacuacgaggacuaccaguccuucgacgagagccucgccaaggcguacaagggcucccugaucagccccuacgagcugcgcuuccgggcccucaacgagcugcuguccaagcaggacuucgcccgcgucauccuccacaucgccaagcggcgcggguacgacgacaucaagaacaacggcgacgaggagaaguccgagauccugaaggccaucaagcagaacgaggagaagcuggugaacuaccagagcgugggcgaguaccucuacaaggaguacuuccagaaguucaaggagaacagcaaggaguucaucaacguccggaacaagaaggaguccuacgagcgcugcaucgcgcagagcuuccugaaggacgagcugaagcucaucuuccagaagcagcgggaguucggguucuccuucagcaagaaguucgaggaggaggugcuguccguggccuucuacaagcgcgcccugaaggacuucagccaccucgucggcaacugcuccuucuucacggacgagaagcgggcccccaagaacagcccccugguguucauguucguggcccugacccgcaucaucaaccuccugaacaaccugaagaacaccgaggggauccucuacaccaaggacgaccugaacgcgcugcucaacgagguccugaagaacggcacgcugaccuacaagcagaccaagaagcuccuggggcugagcgacgacuacgaguucaagggcgagaagggcaccuacuucaucgaguucaagaaguacaaggaguucaucaaggcccucgacgagcacucccugagccaggacgaccugaacgagaucgccaaggacaucacgcucaucaaggacgagaucaagcugaagaaggcccuggccaaguacgaccucaaggagaaccagaucgacucccugagcaagcuggaguucaaggaccaccucaacaucuccuucaaggcgcugaagcugaucaccccgcugaugcucgaggggaagaaguacgacgaggccugcaacgagcugaaccugaagguggccaucaacgaggacaagaaggacuuccuccccgccuucaacgagaccuacuacaaggacgaggugaccaaccccgucgugcugcgggccaucaaggaguaccgcaagauccugaacgcgcuccugaagaaguacggcaaggugcacaagaucaacaucgagcuggcccgcgaggucgggaagaaccacagccagcgggccaagaucgagaaggagcagaacgagaacuacaaggccaagaaggacgcggagcucgagugcgagaagcugggccugaagaucaacuccaagaacauccucaagcugcgccuguucaaggagcagaaggaguucugcguguacagcggcgagaagaucaagcucuccgaccugcaggacgagaagaugcuggagaucgaccacaucuaccccuacagccgguccuucgacgacagcuacaugaacaaggugcucgucuucgccaagcagaaccaggagaagcugaacaagacgccguucgaggccuucgggaacgacuccaccaaguggcagaagaucgaggugcugaccaagaaccuccccaccaagaagcagaagcgcauccuggacaagaacuacaaggacaaggagcagaaggacuucaaggaccggaaccugaacgacacgcgcuacaucgcccggcucgugcugaacuacaccaaggacuaccuggacuuccucccccugagcgacgacgagaacaccaagcugaacgacacccagaagggcuccaagguccacguggaggccaagagcgggaugcucacguccgcgcugcgccacaccuggggcuucagcaccaaggaccggaacaaccaccuccaccacgccaucgacgccgugaucaucgccuacgccaacaacuccaucgucaaggcguucagcgacuucaagaaggagcaggagagcaacuccgccgagcuguacgccaagaagaucagcgagcuggacuacaagaacaagcgcaaguucuucgagcccuucuccggguuccggcagaaggugcuggacaagaucgacgagaucuucgucagcaagccggagcgcaagaagcccuccggcgcccuccacgaggagaccuuccggaaggaggaggaguucuaccagagcuacggcgggaaggagggcgugcugaaggcccuggagcucgggaagauccgcaaggugaacggcaagaucgucaagaacggggacauguuccggguggacaucuucaagcacaagaagacgaacaaguucuacgcggugcccaucuacaccauggacuucgcccugaagguccugcccaacaaggccguggcccgcuccaagaagggcgagaucaaggacuggauccucauggacgagaacuacgaguucugcuucagccuguacaaggacucccugauccucauccagaccaaggacaugcaggagccggagcugguguacuucaacgcguucaccagcuccacggucagccugaucguguccaagcacgacaacaaguucgagacccucagcaagaaccagaagauccuguucaagaacgccaacgagaaggaggugaucgccaaguccaucggcauccagaaccugaaggucuucgagaaguacaucgugagcgcccucggggaggugaccaaggccgaguuccggcagcgcgaggacuucaagaacgagcugcgguga

(The sequence listing continues in the following parts.)

The invention claimed is:
1. An artificial nucleic acid molecule comprising
    a. at least one coding region encoding at least one CRISPR-associated protein comprising an amino acid sequence according SEQ ID NO: 428 or an amino acid sequence having at least 90% sequence identity to the amino acid sequence of SEQ ID NO: 428;
    b. at least one 5' untranslated region (5' UTR) element; and
    c. at least one 3' untranslated region (3' UTR) element,
    wherein said artificial nucleic acid molecule is an RNA and wherein the at least one coding region comprises a nucleic acid sequence at least about 90% identical to one of the sequences of SEQ ID NOs: 2540-2553.

2. The artificial nucleic acid molecule of claim 1, comprising
at least one 5' UTR element derived from a 5'UTR of a HSD17B4 gene; or at least one 5' UTR element derived from a 5'UTR of a NDUFA4 gene.

3. The artificial nucleic acid molecule of claim 1, wherein said 3'UTR element is derived from a PSMB3 gene.

4. The artificial nucleic acid molecule of claim 1, said artificial nucleic acid comprising a nucleic acid sequence encoding a CRISPR-associated protein comprising or consisting of an amino acid sequence according to SEQ ID NO: 428, or an amino acid sequence having at least 95% sequence identity to the amino acid sequence according to SEQ ID NO: 428.

5. The artificial nucleic acid molecule of claim 1, wherein said CRISPR-associated protein comprises at least one further effector domain, selected from KRAB, CSD, WRPW, VP64, p65AD and Mxi.

6. The artificial nucleic acid molecule of claim 1, wherein said artificial nucleic acid further comprises at least one nucleic acid sequence encoding a nuclear localization signal (NLS).

7. The artificial nucleic acid molecule of claim 4, wherein the at least one coding region of said artificial nucleic acid molecule comprises a nucleic acid sequence according to any one of SEQ ID NOs: 2540-2553 or a nucleic acid sequence having at least 95% sequence identity to the any one of said nucleic acid sequences.

8. The artificial nucleic acid molecule of claim 1, which comprises a 5'-CAP structure.

9. The artificial nucleic acid molecule of claim 1, which comprises at least one histone stem-loop.

10. The artificial nucleic acid molecule of claim 8, comprising a poly(A) sequence, comprising 10 to 200 adenosine nucleotides.

11. The artificial nucleic acid molecule of claim 4, which comprises, in 5' to 3' direction, the following elements:
a) a 5'-CAP structure,
b) the 5'-UTR element,
c) the at least one coding sequence,
d) the 3'-UTR element,
e) a poly(A) tail,
f) optionally a poly(C) tail, and
g) optionally a histone stem-loop (HSL).

12. A composition comprising the artificial nucleic acid molecule of claim 1 and a pharmaceutically acceptable carrier and/or excipient.

13. The composition according to claim 12, wherein the artificial nucleic acid molecule is complexed with one or more cationic or polycationic lipids.

14. A kit comprising the artificial nucleic acid molecule of claim 1, and optionally a liquid vehicle and/or optionally technical instructions with information on the administration and dosage of the artificial nucleic acid molecule or the composition.

15. The artificial nucleic acid molecule of claim 1, wherein the at least one 5' UTR element is derived from a 5' UTR of a gene selected from the group consisting of SLC7A3, ATP5A1, RPL32, HSD17B4, NOSIP, ASAH1, RPL31, TUBB4B, UBQLN2, MP68 and NDUFA4.

16. The artificial nucleic acid molecule of claim 1, wherein the at least one 3' UTR element is derived from a 3' UTR of a gene selected from the group consisting of GNAS, CASP1, PSMB3, ALB, COX6B1, NDUFA1 and RPS9.

17. The artificial nucleic acid molecule of claim 11, wherein the at least one coding region comprises a nucleic acid sequence at least about 90% identical to the sequence of SEQ ID NO: 2540.

18. The artificial nucleic acid molecule of claim 17, wherein the at least one coding region comprises a nucleic acid sequence at least about 95% identical to the sequence of SEQ ID NO: 2540.

* * * * *

UNITED STATES PATENT AND TRADEMARK OFFICE
CERTIFICATE OF CORRECTION

| | | |
|---|---|---|
| PATENT NO. | : 11,739,335 B2 | Page 1 of 1 |
| APPLICATION NO. | : 16/496518 | |
| DATED | : August 29, 2023 | |
| INVENTOR(S) | : Chevessier-Tünnesen et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 735 days.

Signed and Sealed this
Twelfth Day of November, 2024

Katherine Kelly Vidal
*Director of the United States Patent and Trademark Office*